United States Patent
Dower et al.

(10) Patent No.: US 11,254,729 B2
(45) Date of Patent: *Feb. 22, 2022

(54) IL-7R-α BINDING COMPOUNDS

(71) Applicant: MEDIKINE, INC., Menlo Park, CA (US)

(72) Inventors: William J. Dower, Menlo Park, CA (US); Michael C. Needels, Menlo Park, CA (US); Ronald W. Barrett, Menlo Park, CA (US); Alice V. Bakker, Menlo Park, CA (US); Steven E. Cwirla, Menlo Park, CA (US)

(73) Assignee: MEDIKINE, INC., Menlo Park, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/166,441

(22) Filed: Feb. 3, 2021

(65) Prior Publication Data

US 2021/0253669 A1 Aug. 19, 2021

Related U.S. Application Data

(60) Provisional application No. 62/969,432, filed on Feb. 3, 2020.

(51) Int. Cl.
*C07K 14/715* (2006.01)

(52) U.S. Cl.
CPC ...... *C07K 14/7155* (2013.01); *C07K 2319/30* (2013.01)

(58) Field of Classification Search
CPC ...... C07K 14/00; C07K 7/00; C07K 14/7155; C07K 2319/30
See application file for complete search history.

(56) References Cited

U.S. PATENT DOCUMENTS

| | | | |
|---|---|---|---|
| 5,635,597 | A | 6/1997 | Barrett et al. |
| 9,861,705 | B2 | 1/2018 | Bossard et al. |
| 10,689,417 | B2 | 6/2020 | Dower et al. |
| 10,703,776 | B2 | 7/2020 | Dower et al. |
| 2003/0166163 | A1 | 9/2003 | Gillies |
| 2011/0243887 | A1 | 10/2011 | Lauder et al. |
| 2013/0330296 | A1 | 12/2013 | Khaled |
| 2017/0327555 | A1 | 11/2017 | Greve |
| 2018/0125941 | A1 | 5/2018 | Greve |
| 2018/0162919 | A1 | 6/2018 | Greve et al. |
| 2018/0362655 | A1 | 12/2018 | Wang et al. |
| 2019/0119346 | A1 | 4/2019 | Garcia et al. |
| 2019/0153058 | A1 | 5/2019 | Greve |
| 2019/0194255 | A1 | 6/2019 | Tagaya et al. |
| 2019/0202881 | A1 | 7/2019 | Greve |
| 2019/0202882 | A1 | 7/2019 | Greve |
| 2020/0040034 | A1 | 2/2020 | Dower et al. |

FOREIGN PATENT DOCUMENTS

| | | |
|---|---|---|
| WO | 2010/099084 | 9/2010 |
| WO | 2017/136818 | 8/2017 |

OTHER PUBLICATIONS

Dower, W., et al. MDK1319/MDK-701: a potent fully efficacious peptidyl agonist of IL-7RagC, designed with no reference to cytokine or receptor structure and unrelated to IL-7, fused to an Fc-domain for PK enhancement. J. Immunother. Cancer., Nov. 2020, 8(Suppl. 3): Abstract 567.*
Mcelroy, C.A., et al. Structural reorganization of the interleukin-7 signaling complex. Proc. Natl. Acad. Sci. USA, 2012, 109(7):2503-2508.*
Partial International Search for PCT Application No. PCT/US2019/045109, dated Nov. 5, 2019, 17 pages.
International Search Report and Written Opinion for PCT Application No. PCT/US2019/045109, dated Jan. 14, 2020, 20 pages.
Klein et al., "Cergutuzumab amunaleukin (CEA-IL2v), a CEA-targeted IL-2 variant-based immunocytokine for combination cancer immunotherapy: Overcoming limitations of aldeslukin and conventional IL-2-based immunocytokines," OncoImmunology, 2017, vol. 6, No. 3, e1277306, 15 pages.
Levin et al., "Exploiting a natural conformational switch to engineer an interleukin-2 'superkine'," Nature, Apr. 2012, vol. 484, p. 529-533.
Mitra et al., "Interleukin-2 Activity can be Fine-Tuned with Engineered Receptor Signaling Clamps," Immunity, May 2015, vol. 42, No. 5, 29 pages.
Pulliam et al., "Common gamma chain cytokines in combinatorial immune strategies against cancer," Immunology Letters, 2016, vol. 169, p. 61-72.
International Search Report and Written Opinion for PCT Application No. PCT/US2021/016356, dated Jul. 13, 2021, 12 pages.
International Search Report and Written Opinion for PCT Application No. PCT/US2021/016361, dated Jul. 15, 2021, 12 pages.
Betts et al., "Chapter 14: Amino Acid Properties and Consequences of Substitutions, Bioinformatics for Geneticists", 2003, Barnes and Gray Eds., 28 pages.
Chen et al., "Fusion Protein Linkers: Property, Design and Functionality", Advanced Drug Delivery Reviews, Oct. 2013, vol. 65, No. 10, pp. 1357-1369.
Moors et al., "Interneukin-7 (IL-7) and IL-7 splice variants affect differentiation of human neural progenitor cells", Genes and Immunity, 2010, vol. 11, pp. 11-20.
UNIPROTKB Accession No. A0A444GHQ1, May 8, 2019, retrieved from https://www.uniprot.org/uniprot/A0A444GHQ1, entire document retrieved on Jun. 12, 2021.
UNIPROTKB Accession No. A0A0N1IMW7, Dec. 9, 2015, retrieved from https://www.uniprot.org/uniprot/A0A0N1IMW7, entire document retrieved on Jun. 12, 2021.
International Search Report and Written Opinion for PCT Application No. PCT/US2020/058963, dated Apr. 7, 2021, 12 pages.

(Continued)

*Primary Examiner* — Prema M Mertz

(57) ABSTRACT

IL-7Rα ligands and compounds comprising IL-7Rα ligands are disclosed. The IL-7Rα binding compounds include fusion proteins comprising the IL-7Rα ligands and can act as IL-7R agonists.

9 Claims, 1 Drawing Sheet

Specification includes a Sequence Listing.

(56) References Cited

OTHER PUBLICATIONS

International Search Report and written Opinion for PCT Application No. PCT/US2020/058969, dated Apr. 6, 2021, 14 pages.
UNIPROTKB Accession No. A0A227JM75, Oct. 25, 2017, retrieved from https://www.uniprot.org/uniprot/A0A227JM75, entire document retrieved on Mar. 22, 2021, 5 pages.
UNIPROTKB Accession No. A0A2D7IYS8, Apr. 25, 2018, retrieved from https://www.uniprot.org/uniprot/A0A2D7IYS8, entire document retrieved on Mar. 19, 2021, 3 pages.
UNIPROTKB Accession No. A0A1D1ZF92, Nov. 30, 2016, retrieved from https://www.uniprot.org/uniprot/A0A1D1ZF92, entire document retrieved on Mar. 19, 2021, 3 pages.

* cited by examiner

| IL-7Rα / Rγc Ligand No. | Orientation P1/P2 | IL-7Rα Ligand | | | Linker Structure | Rγc Ligand | | |
|---|---|---|---|---|---|---|---|---|
| | | N-terminus | Amino Acid Sequence | C-terminus | | N-terminus | Amino Acid Sequence | C-terminus |
| A | C/N | H₂N– | –GG–HLGVPWCTLDPGSIQCAWLAKH–G– SEQ ID NO: 462 | AL2 | L11 | AZ4 | –GG–VVCQDWEGVELCWQ– GG– SEQ ID NO: 465 | –C(O)– NH₂ |
| B | C/C | H₂N– | –GG–HLGVPWCTLDPGSIQCAWLAKH–GG– SEQ ID NO: 463 | AL2 | L10 | H₂N– | –GG–VVCQDWEGVELCWQ– GG– SEQ ID NO: 465 | AZ5 |
| C | N/N | AL4 | –GG–HLGVPWCTLDPGSIQCAWLAKH–G– SEQ ID NO: 462 | –C(O)–NH₂ | L8 | AZ4 | –GG–VVCQDWEGVELCWQ– GG– SEQ ID NO: 465 | –C(O)– NH₂ |
| D | N/C | AL4 | –GG–HLGVPWCTLDPGSIQCAWLAKH–G– SEQ ID NO: 462 | –C(O)–NH₂ | L9 | H₂N– | –GG–VVCQDWEGVELCWQ– GG– SEQ ID NO: 465 | AZ5 |
| E | C/N | H₂N– | –VHRIPWCTLDPGGLQCAWLRQM–GG– SEQ ID NO: 554 | AL2 | L11 | AZ4 | –GG–VVCQDWEGVELCWQ– GG– SEQ ID NO: 465 | –C(O)– NH₂ |

IL-7R-α BINDING COMPOUNDS

This application claims the benefit under 35 U.S.C. § 119(e) of U.S. Provisional Application No. 62/969,432 filed on Feb. 3, 2020, which is incorporated by reference in its entirety.

FIELD

The present disclosure relates to IL-7Rα ligands and to compounds having an IL-7Rα ligand. Compounds such as synthetic heterodimers and recombinant fusion proteins comprising an IL-7Rα ligand can be IL-7R agonists.

SEQUENCE LISTING

The Sequence Listing associated with this application is filed in electronic format by EFS-Web and is incorporated by reference in its entirety. Said ASCII copy, created on Mar. 4, 2021, is named 62AJ-000710PC-326164_SL.txt and is 596,234 bytes in size.

BACKGROUND

Interleukin-7 (IL-7) is required for development of cells and maintenance of mature T-cell homeostasis; and plays an important role in the establishment of the B-cell repertoire. Unlike most interleukins, IL-7 is primarily produced by non-hematopoietic stromal cells rather than leukocytes: T-, B-, and NK cells do not produce IL-7. Under normal conditions, free IL-7 levels are limiting, but accumulate during lymphopenia, leading to increased T cell proliferation and replenishment of the T-cell populations. Recombinant human IL-7 administered to humans, non-human primates and mice, produces widespread T cell proliferation, increased T cell numbers, modulation of peripheral T cell subsets and increased T cell receptor repertoire diversity. These effects may be therapeutically useful in a variety of clinical settings.

IL-7 is a member of the common γ chain (γc-CD132) family of cytokines that includes interleukin-2 (IL-2), IL-4, IL-7, IL-9, IL-15, and IL-21. IL-7 signals via an active complex formed with its unique α-receptor, IL-7Rα (CD127), and the common γc receptor (Rγc). Receptor activation leads to signaling through an array of pathways, including JAK-STAT, P13K-AKT, and Src kinases.

The IL-7Rα receptor subunit exists in two states: a full-length membrane-bound form that, with Rγc, mediates IL-7R signal transduction; and a truncated (soluble) form of the extracellular domain that may provide regulation of extracellular IL-7 levels and modulation of IL-7R signaling.

The cell surface signaling-competent form of Il-7Rα is expressed on most resting T-cells and is down regulated upon T-cell activation or IL-7 stimulation. T-cells continue to express IL-7R in both naïve and memory states, and IL-7R signaling is necessary for long-term maintenance of T cell populations, in part by modulating apoptosis; both CD4 and CD8 memory T-cells continue to be dependent on IL-7 for long-term survival.

Emerging evidence suggests IL-7R agonists may be useful in immuno-oncology therapy. For example, IL-7 is effective in increasing cytotoxic CD8+ T lymphocytes (CD8+ T-cell); and long-term tumor antigen specific CD8+ T-cell responses are enhanced by IL-7 treatment.

IL-7 exhibits inhibitory effects in tumors such as glioma, melanoma, lymphoma, leukemia, prostate cancer, and glioblastoma; and administration of IL-7 in murine tumor models has shown decreased cancer cell growth. IL-7 has been shown to enhance the antitumor effect of interferon-γ (IFNγ) in rat glioma tumors, and can induce the production of IL-1α, IL-1β, and TNF-α by monocytes, which can inhibit tumor growth.

IL-7 has been shown to have potential in the treatment of lymphopenias, septic shock, and infectious disease.

IL-7/IL-7R signaling has been implicated in autoimmune, chronic inflammatory diseases, and cancer, and therefore therapeutic targeting of the IL-7/IL-7R pathway is expected to have clinical benefit.

Importantly, administration of recombinant IL-7 has been found to be well tolerated in clinical trials.

SUMMARY

According to the present invention, IL-7Rα ligands are disclosed that bind to the human IL-7Rα subunit with an $IC_{50}$ of less than 100 μM.

According to the present invention, an IL-7Rα ligand can comprise the amino acid sequence of any one of Formula (1)-(10g).

According to the present invention, an IL-7Rα ligand can comprise the amino acid sequence of any one of SEQ ID NOS: 1-410 and 520-655.

According to the present invention, an IL-7Rα binding compound can comprise an IL-7Rα ligand according to the present invention.

According to the present invention, a pharmaceutical composition can comprise an IL-7Rα ligand according to the present invention and/or an IL-7Rα binding compound according to the present invention.

According to the present invention, methods of treating cancer, an autoimmune disease, or an inflammatory disease in a patient can comprise administering to a patient in need thereof a therapeutically effective amount of an IL-7Rα ligand according to the present invention, an IL-7Rα binding compound of claim 4, or a pharmaceutical composition according to the present invention.

According to the present invention, a nucleic acid can encode for the IL-7Rα ligand according to the present invention or an IL-7Rα binding compound according to the present invention.

According to the present invention, a unique binding site on the IL-7Rα subunit is disclosed, wherein the unique binding site is characterized by the following properties:

(a) a group of IL-7Rα ligands bind to the unique binding site on the hIL-7Rα subunit with an $IC_{50}$ of less than 10 μM, wherein the group of IL-7Rα ligands comprises the IL-7Rα ligands having SEQ ID NOS: 5, 43, 104, 146, and 458;

(b) each of the IL-7Rα ligands within the group competitively bind to the unique binding site on the hIL-7Rα subunit with each of other IL-7Rα ligands within the group;

(c) a peptide having the amino acid sequence of SEQ ID. No: 429 does not compete for binding to the unique binding site on the hIL-7Rα subunit with the peptides within the group of IL-7Rα ligands; and (d) IL-7Rα ligands having SEQ ID NOS: 5, 43, 104, 146, and 458 do not bind competitively with IL-7 binding to IL-7Rα.

According to the present invention, an IL-7Rα binding compound of the present invention can bind to the unique binding site with an $IC_{50}$ of less than 100 μM.

According to the present invention, methods of treating a disease in a patient can comprise administering to a patient in need thereof a therapeutically effective amount of a compound capable of binding to the unique binding site with an $IC_{50}$ of less than 100 µM or pharmaceutically acceptable salt thereof.

Reference is now made to certain compounds and methods. The disclosed embodiments are not intended to be limiting of the claims. To the contrary, the claims are intended to cover all alternatives, modifications, and equivalents.

BRIEF DESCRIPTION OF THE DRAWINGS

The drawings described herein are for illustration purposes only. The drawings are not intended to limit the scope of the present disclosure.

FIG. 1 shows the chemical structure of certain heteromers containing different C/N orientations of IL-7Rα and Rγc ligands.

DETAILED DESCRIPTION

A dash ("-") that is not between two letters or symbols is used to indicate a point of attachment for a moiety or substituent. For example, —$CONH_2$ is attached through the carbon atom and —$X^1$-$X^2$— denotes amino acids $X^1$ and $X^2$ covalently bonded through a single bond.

"Binding affinity" refers to the strength of the binding interaction between a single biomolecule and its ligand/binding partner. Binding affinity is expressed as the $IC_{50}$ value. Binding affinity can be determined by phage ELISA competition assays.

"Direct binding" refers to the binding interaction between a single biomolecule and its binding partner such as the interaction of an IL-7Rα ligand and the hIL-7Rα subunit. Direct binding can be determined using phage ELISA assays.

"Agonist" refers to a biologically active compound that binds to its complementary biologically active receptor or receptor subunit(s) and activates the receptor to cause a biological response mediated by the receptor, or to enhance a preexisting biological activity mediated by the receptor.

"Partial agonist" refers to a compound that provides a level of activation, that is, for example, less than 75% of maximum activation, less than 50%, less than 25%, less than 10%, or less than 1% of the maximum activation. For example, partial IL-7R agonist exhibits a level of activation that is less than the level of activation provided by IL-7.

"Antagonist" refers to a biologically active compound that binds to its complementary receptor or receptor subunit(s) and blocks or reduces a biological response of the receptor. An IL-7R antagonist can bind to IL-7R with an $IC_{50}$ of less than 100 µM and has no detectable functional activity as determined, for example, using any of the functional assays disclosed in the examples.

Amino acid residues are abbreviated as follows: alanine is Ala or A; arginine is Arg or R; asparagine is Asn or N; aspartic acid is Asp or D; cysteine is Cys or C; glutamic acid is Glu or E; glutamine is Gln or Q; glycine is Gly or G; histidine is His or H; isoleucine is Ile or I; leucine is Leu or L; lysine is Lys or K; methionine is Met or M; phenylalanine is Phe or F; proline is Pro or P; serine is Ser or S; threonine is Thr or T; tryptophan is Trp or W; tyrosine is Tyr or Y; and valine is Val or V.

"Non-natural amino acids" include, for example, β-amino acids, homo-amino acids, proline and pyruvic acid derivatives, histidine derivatives with alkyl or heteroatom moieties attached to the imidazole ring, amino acids with pyridine-containing side chains, 3-substituted alanine derivatives, glycine derivatives, ring-substituted phenylalanine and tyrosine derivatives, and N-methyl amino acids.

Amino acids having a large hydrophobic side chain include isoleucine (I), leucine (L), methionine (M), valine (V), phenylalanine (F), tyrosine (Y), and tryptophan (W).

Amino acids having a small hydrophobic side chain include alanine (A), glycine (G), proline (P), serine (S), and threonine (T).

Amino acids having a basic side chain include arginine (R), lysine (K), and histidine (H).

Amino acids having an acidic side chain include aspartate (D) and glutamate (E).

Amino acids having a polar/neutral side chain include histidine (H), asparagine (N), glutamine (Q), serine (S), threonine (T), and tyrosine (Y).

Amino acids having an aromatic side chain include phenylalanine (F), histidine (H), tryptophan (W), and tyrosine (Y).

Amino acids having a hydroxyl side chain include serine (S), threonine (T), and tyrosine (Y).

"Conservative amino acid substitution" means that amino acids within each of the following groups can be substituted with another amino acid within the group: amino acids having a small hydrophobic side chain comprising alanine (A), glycine (G), proline (P), serine (S), and threonine (T); amino acids having a hydroxyl-containing side chain comprising serine (S), threonine (T), and tyrosine (Y); amino acids having an acidic side chain comprising aspartate (D) and glutamate (E); amino acids comprising a polar-neutral side chain comprising histidine (H), asparagine (N), glutamine (Q), serine (S), threonine (T), and tyrosine (Y); amino acids having a basic side chain comprising arginine (R), lysine (K), and histidine (H); amino acids having a large hydrophobic side chain comprising isoleucine (I), leucine (L), methionine (M), valine (V), phenylalanine (F), tyrosine (Y), and tryptophan (W)); and amino acids having an aromatic side chain comprising phenylalanine (F), histidine (H), tryptophan (W), and tyrosine (Y).

Molecular weight in the context of a polymer refers to the number average molecular weight as determined by gel permeation chromatography using a polystyrene standard or the molecular weight determined by the known molecular structure. A polymer can have a polydispersity index (i.e., number average molecular weight and weight average molecular weight of the polymers are not equal), for example, less than 1.2, less than 1.15, less than 1.10, less than 1.05, or less than 1.03.

A ligand linker refers to a moiety that binds at least one IL-7R ligand such as an IL-7Rα ligand to another IL-7R ligand such as an IL-7Rα ligand and/or to an Rγc ligand. A ligand linker can bind to another IL-7R ligand which can be the same IL-7Rα ligand or a different IL-7Rα ligand. A ligand linker can be divalent or multivalent. A ligand linker can be hydrolytically stable or can include a physiologically hydrolyzable or enzymatically degradable ligand linkage. A ligand linker can bind IL-7Rα ligands to form dimers, trimers, or higher order multi-ligand peptides (heteromers) and compounds. A ligand linker can be a peptidyl ligand linker or a chemical ligand linker.

A "physiologically cleavable" or "hydrolyzable" or "degradable" bond is a bond that reacts with water (i.e., is hydrolyzed) under physiological conditions. The tendency of a bond to hydrolyze in water will depend not only on the general type of linkage connecting two central atoms but also on the substituents attached to these central atoms. Suitable hydrolytically unstable or weak linkages include but are not limited to carboxylate ester, phosphate ester, anhydrides, acetals, ketals, acyloxyalkyl ether, imines, orthoesters, peptides and oligonucleotides.

An "enzymatically degradable linkage" means a linkage that can be degraded or cleaved by one or more enzymes.

A "hydrolytically stable" linkage or bond refers to a chemical bond, such as a covalent bond, that is substantially stable in water such that the chemical bond does not undergo hydrolysis under physiological conditions to any appreciable extent over an extended period of time. Examples of hydrolytically stable linkages include, but are not limited to, the following: carbon-carbon bonds (e.g., in aliphatic chains), ethers, amides, urethanes, and the like. Generally, a hydrolytically stable linkage is one that exhibits a rate of hydrolysis of less than about 1% to 2% per day under physiological conditions.

An "IL-7Rα ligand" refers to a peptide capable of binding to the IL-7Rα subunit of a mammalian IL-7 receptor, such as a human IL-7 receptor, with an $IC_{50}$ less than 100 μM.

The "hIL-7Rα subunit" refers to the human (*Homo sapiens*) interleukin-7 receptor subunit α precursor NCBI Reference Sequence NP_002176.2.

An "IL-7Rα ligand fusion protein" refers to a protein made by recombinant DNA technology in which the translational reading frame of an IL-7Rα ligand is fused to that of another protein, i.e., the IL-7Rα ligand fusion partner, to produce a single recombinant polypeptide. An IL-7Rα ligand fusion protein can comprise one or more IL-7Rα ligands and optionally one or more Rγc ligands. An IL-7Rα ligand-fusion partner can comprise the Fc domain of an IgG molecule where the IL-7Rα ligand is attached to one or both C-termini of the Fc structures. An IL-7Rα ligand-fusion protein can include a peptidyl linker such as an amino acid sequence coupling the IL-7Rα ligand to the fusion protein partner, such that the peptidyl linker amino acid sequence is not derived from either the IL-7Rα ligand or the fusion protein partner. Such linkers are referred to as construct linkers. Construct linkers can be incorporated into fusion proteins as spacers to promote proper protein folding and stability of the component protein moieties, to improve protein expression, and/or to enable better bioactivity of the two fusion partners. Construct linkers can include, for example, flexible peptides and/or rigid peptides. A construct linker can be a chemical construct linker.

An "IL-7Rα ligand construct" refers to a compound comprising one or more IL-7Rα ligands bound to a construct partner. An IL-7Rα ligand construct also includes compounds in which one or more IL-7Rα ligands and one or more Rγc ligands are bound to a construct partner. The IL-7Rα ligand can be bound to the construct partner through a construct linker.

An "IL-7Rα binding compound" refers to a compound comprising at least one IL-7Rα ligand that binds to the hIL-7Rα subunit with an $IC_{50}$, for example, of less than 100 μM, less than 10 μM, less than 100 nM, less than 10 nM, or less than 1 nM. An IL-7Rα binding compound can be, for example, an IL-7Rα ligand, a homomeric IL-7Rα ligand, a heteromeric IL-7Rα ligand, or an IL-7Rα ligand construct. IL-7Rα binding compounds include compounds comprising at least one IL-7Rα ligand provided by the present disclosure and at least one other ligand such as an Rγc ligand capable of interacting with and/or binding to IL-7R.

A "Rγc ligand" refers to a peptide capable of binding to the Rγc subunit of a mammalian IL-7 receptor, such as a human IL-7 receptor, with an $IC_{50}$ of less than 100 μM.

The "Rγc subunit" refers to the human (*Homo sapiens*) interleukin-2 receptor subunit γ precursor NCBI Reference Sequence NP_000197.1.

Bioisosteres are atoms or molecules that fit the broadest definition for isosteres. The concept of bioisosterism is based on the concept that single atom, groups, moieties, or whole molecules, which have chemical and physical similarities produce similar biological effects. A bioisostere of a parent compound can still be recognized and accepted by its appropriate target, but its functions will be altered as compared to the parent molecule. Parameters affected with bioisosteric replacements include, for example, size, conformation, inductive and mesomeric effects, polarizability, capacity for electrostatic interactions, charge distribution, H-bond formation capacity, pKa (acidity), solubility, hydrophobicity, lipophilicity, hydrophilicity, polarity, potency, selectivity, reactivity, or chemical and metabolic stability, ADME (absorption, distribution, metabolism, and excretion). Although common in pharmaceuticals, carboxyl groups or carboxylic acid functional groups ($-CO_2H$) in a parent molecule may be replaced with a suitable surrogate or (bio)isostere to overcome chemical or biological shortcomings while retaining the desired attributes of the parent molecule bearing one or more carboxyl groups or carboxylic acid functional groups ($-CO_2H$).

"Isostere" or "isostere replacement" refers to any amino acid or other analog moiety having physiochemical and/or structural properties similar to a specified amino acid. An "isostere" or "suitable isostere" of an amino acid is another amino acid of the same class, wherein amino acids belong to the following classes based on the propensity of the side chain to be in contact with polar solvent like water: hydrophobic (low propensity to be in contact with water), polar or charged (energetically favorable contact with water). Examples of charged amino acid residues include lysine (+), arginine (+), aspartate (−) and glutamate (−). Examples of polar amino acids include serine, threonine, asparagine, glutamine, histidine and tyrosine. Illustrative hydrophobic amino acids include alanine, valine, leucine, isoleucine, proline, phenylalanine, tryptophan, cysteine and methionine. The amino acid glycine does not have a side chain and is difficult to assign to one of the above classes. However, glycine is often found at the surface of proteins, often within loops, providing high flexibility to these regions, and an isostere may have a similar feature. Proline has the opposite effect, providing rigidity to the protein structure by imposing certain torsion angles on the segment of the polypeptide chain. An isostere can be a derivative of an amino acid, e.g., a derivative having one or more modified side chains as compared to the reference amino acid.

"Cyclized" refers to a structure in which one part of a peptide or polypeptide is linked to another part of the peptide or polypeptide molecule to form a closed ring, such as by forming a disulfide bridge or other similar bond, e.g., a lactam bond. A peptide such as an IL-7Rα ligand can include cysteines that are bound together through disulfide bonds and thereby are cyclized IL-7Rα ligands.

"Patient" refers to a mammal, for example, a human.

"Peptide" refers to a polymer in which the monomers include amino acids joined together through amide bonds. A peptide can comprise, for example, less than 200 amino acids, less than 100 amino acids, less than 50 amino acids, less than 40 amino acids, less than 30 amino acids, or less than 20 amino acids. A peptide can comprise naturally occurring amino acids, non-naturally occurring amino acids, or a combination thereof.

In addition to peptides consisting only of naturally occurring amino acids, peptidomimetics or peptide analogs are also provided. Peptide mimetics that are structurally similar to therapeutically useful peptides may be used to produce an equivalent or enhanced therapeutic or prophylactic effect. Generally, peptidomimetics are structurally similar to a paradigm peptide, for example, a peptide that has a biological or pharmacological activity, such as a naturally occurring receptor-binding peptide, but have one or more peptide linkages optionally replaced by a linkage such as —CH$_2$—NH—, —CH$_2$—S—, —CH$_2$—CH$_2$—, —CH=CH— (cis and trans), —COCH$_2$—, —CH(OH)CH$_2$—, and —CH$_2$SO—, by methods known in the art.

Substitution of one or more amino acids of a consensus sequence with a D-amino acid of the same type, such as D-lysine in place of L-lysine, may be used to generate more stable peptides. In addition, constrained peptides comprising a consensus sequence, or a substantially identical consensus sequence variation may be generated by methods known in the art; for example, by adding internal cysteine residues capable of forming intramolecular disulfide bridges which cyclize the peptide.

Synthetic or non-naturally occurring amino acids refer to amino acids that do not naturally occur in vivo but which, nevertheless, can be incorporated into the peptide ligands provided by the present disclosure. Suitable examples of synthetic amino acids include the D-α-amino acids of naturally occurring L-α-amino acid as well as non-naturally occurring D- and L-α-amino acids represented by the formula H$_2$NCHR$^5$COOH where R$^5$ is C$_{1-6}$ alkyl, C$_{3-8}$ cycloalkyl, C$_{3-8}$ heterocycloalkyl; an aromatic residue of from 6 to 10 carbon atoms optionally having from 1 to 3 substituents on the aromatic nucleus selected from hydroxyl, lower alkoxy, amino, and carboxyl; -alkylene-Y where alkylene is an alkylene group of from 1 to 7 carbon atoms and Y is selected from a hydroxyl, amino, cycloalkyl, and cycloalkenyl having from 3 to 7 carbon atoms; aryl of from 6 to 10 carbon atoms, such as from 1 to 3 substituents on the aromatic nucleus selected hydroxyl, lower alkoxy, amino and carboxyl; heterocyclic of from 3 to 7 carbon atoms and 1 to 2 heteroatoms selected from oxygen, sulfur, and nitrogen; —C(O)R$^2$ where R$^2$ is selected from hydrogen, hydroxy, lower alkyl, lower alkoxy, and —NR$^3$R$^4$ where each of R$^3$ and R$^4$ is independently selected from hydrogen and lower alkyl; —S(O)$_n$R$^6$ where n is 1 or 2 and R$^6$ is C$_{1-6}$ alkyl, and with the proviso that R$^6$ does not define a side chain of a naturally occurring amino acid.

Examples of other synthetic amino acids include amino acids in which the amino group is separated from the carboxyl group by more than one carbon atom such as β-alanine and γ-aminobutyric acid.

Examples of suitable synthetic amino acids include the D-amino acids of naturally occurring L-amino acids, L-1-naphthyl-alanine, L-2-naphthylalanine, L-cyclohexylalanine, L-2-amino isobutyric acid, the sulfoxide and sulfone derivatives of methionine, i.e., HOOC—(H$_2$NCH)CH$_2$CH$_2$—S(O)$_n$R$^6$, where n and R$^6$ are as defined above as well as the lower alkoxy derivative of methionine such as HOOC—(H$_2$NCH)CH$_2$CH$_2$OR$^6$ where R$^6$ is as defined above.

"N-terminus" refers to the end of a peptide or polypeptide, such as an N-terminus of an IL-7Rα binding compound that bears an amino group in contrast to the carboxyl end bearing a carboxylic acid group.

"C-terminus" refers to the end of a peptide or polypeptide, such as a C-terminus of an IL-7Rα binding compound that bears a carboxylic acid group in contrast to the amino terminus bearing an amino group.

"Pharmaceutically acceptable" refers to approved or approvable by a regulatory agency of the Federal or a state government or listed in the U.S. Pharmacopoeia or other generally recognized pharmacopoeia for use in animals, and more particularly in humans.

"Pharmaceutically acceptable salt" refers to a salt of a compound, which possesses a desired pharmacological activity of the parent compound. Such salts include acid addition salts, formed with inorganic acids and one or more protonate-able functional groups such as primary, secondary, or tertiary amines within the parent compound. Examples of inorganic acids include hydrochloric acid, hydrobromic acid, sulfuric acid, nitric acid, and phosphoric acid. A salt can be formed with organic acids such as, for example, acetic acid, propionic acid, hexanoic acid, cyclopentanepropionic acid, glycolic acid, pyruvic acid, lactic acid, malonic acid, succinic acid, malic acid, maleic acid, fumaric acid, tartaric acid, citric acid, benzoic acid, 3-(4-hydroxybenzoyl) benzoic acid, cinnamic acid, mandelic acid, methanesulfonic acid, ethanesulfonic acid, 1,2-ethane-disulfonic acid, 2-hydroxyethanesulfonic acid, benzenesulfonic acid, 4-chlorobenzenesulfonic acid, 2-naphthalenesulfonic acid, 4-toluenesulfonic acid, camphorsulfonic acid, 4-methylbicyclo[2.2.2]-oct-2-ene-1-carboxylic acid, glucoheptonic acid, 3-phenylpropionic acid, trimethylacetic acid, tertiary butylacetic acid, lauryl sulfuric acid, gluconic acid, glutamic acid, hydroxynaphthoic acid, salicylic acid, stearic acid, or muconic acid. A salt can be formed when one or more acidic protons present in the parent compound are replaced by a metal ion, e.g., an alkali metal ion, an alkaline earth ion, or an aluminum ion, or combinations thereof; or coordinates with an organic base such as ethanolamine, diethanolamine, triethanolamine, or N-methylglucamine. A pharmaceutically acceptable salt can be a hydrochloride salt. A pharmaceutically acceptable salt can be a sodium salt. A compound can have two or more ionizable groups, and a pharmaceutically acceptable salt can comprise one or more counterions, such as a bi-salt, for example, a dihydrochloride salt.

"Pharmaceutically acceptable salt" includes hydrates and other solvates, as well as salts in crystalline or non-crystalline form. Where a particular pharmaceutically acceptable salt is disclosed, it is understood that the particular salt (e.g., a hydrochloride salt) is an example of a salt, and that other salts may be formed using techniques known to one of skill in the art.

"Pharmaceutically acceptable vehicle" refers to a pharmaceutically acceptable diluent, a pharmaceutically acceptable adjuvant, a pharmaceutically acceptable excipient, a pharmaceutically acceptable carrier, or a combination of any of the foregoing with which a therapeutic compound provided by the present disclosure may be administered to a patient and maintains the pharmacological activity thereof and which is non-toxic when administered in doses sufficient to provide a therapeutically effective amount of the therapeutic compound.

"Preventing" or "prevention" refers to a reduction in risk of acquiring a disease or disorder (i.e., causing at least one of the clinical symptoms of the disease not to develop in a patient that may be exposed to or predisposed to the disease but does not yet experience or display symptoms of the disease). In some embodiments, "preventing" or "prevention" refers to reducing symptoms of the disease by taking the compound in a preventative fashion.

"Therapeutically effective amount" refers to the amount of a compound that, when administered to a patient for treating a disease, or at least one of the clinical symptoms of a disease, is sufficient to treat the disease or symptom thereof. A "therapeutically effective amount" may vary depending, for example, on the compound, the disease and/or symptoms of the disease, severity of the disease and/or symptoms of the disease or disorder, the age, weight, and/or health of the patient to be treated, and the judgment of a prescribing physician. An appropriate amount in any given instance may be ascertained by those skilled in the art or capable of determination by routine experimentation.

"Therapeutically effective dose" refers to a dose of a therapeutic compound such as an IL-7Rα binding compound that provides effective treatment of a disease or disorder in a patient. A therapeutically effective dose may vary from compound to compound, and from patient to patient, and may depend upon factors such as the condition of the patient and the route of delivery. A therapeutically effective dose may be determined in accordance with pharmacological procedures known to those skilled in the art.

"Treating" or "treatment" of a disease refers to arresting or ameliorating a disease or at least one of the clinical symptoms of a disease or disorder, reducing the risk of acquiring a disease or at least one of the clinical symptoms of a disease, reducing the development of a disease or at least one of the clinical symptoms of the disease or reducing the risk of developing a disease or at least one of the clinical symptoms of a disease. "Treating" or "treatment" also refers to inhibiting the disease, either physically, (e.g., stabilization of a discernible symptom), physiologically, (e.g., stabilization of a physical parameter), or both, and to inhibiting at least one physical parameter or manifestation that may or may not be discernible to the patient. In certain embodiments, "treating" or "treatment" refers to delaying the onset of the disease or at least one or more symptoms thereof in a patient who may be exposed to or predisposed to a disease or disorder even though that patient does not yet experience or manifest symptoms of the disease.

"Tregs" or "Treg cells" refer to regulatory T-cells. Regulatory T-cells are a class of T-cells that suppress the activity of other immune cells and are defined using flow cytometry by the cell marker phenotypes CD4+/CD25+/FOXP3+, CD4+CD25+CD127lo, or CD4+/CD25+/FOXP3+/CD127lo. Because FOXP3 is an intracellular protein and requires cell fixation and permeabilization for staining, the cell surface phenotype CD4+CD25+CD127lo− can be used for defining live Tregs. Tregs also include various Treg subclasses, such as tTregs (thymus-derived) and pTregs (peripherally derived, differentiated from naive T-cells in the periphery).

"CD4+T cells" are a type of lymphocyte that functions to coordinate the immune response by stimulating other immune cells such as macrophages, B lymphocytes (B cells), CD8 lymphocytes (CD8 cells) to fight infection. CD4+T cells recognize peptides presented on MHC Class II molecules, which are found on antigen-presenting cells.

"CD8+ (cytotoxic) T-cells" are generated in the thymus and express the T-cell receptor. CD8+T-cells express a dimeric co-receptor, CD8, which typically comprises one CD8α and one CD8β chain. CD8+T-cells recognize peptides presented by MHC Class 1 molecules found on all nucleated cells. The CD8 heterodimer binds to a conservative portion of MHC Class 1 during T-cell/antigen presenting cell interactions. CD8+T-cells (cytotoxic T lymphocytes, or CTLs) are important for immune defense against intracellular pathogens including viruses and bacteria, and for tumor surveillance.

"NK (natural killer) cells" are lymphocytes in the same family as T- and B-cells and, as cells of the innate immune system, are classified as group I innate lymphocytes (ILCs). NK cells respond to a wide variety of pathological challenges including by killing virally infected cells and detecting and controlling early signs of cancer.

"Functional activation of cells" refers to an IL-7R-mediated response in cells. Assays for functional activation of cells include stimulation of pSTAT5, cell proliferation or markers of proliferation (such as Ki67), change in immune cell type ratios, and stimulation of the levels of effector proteins.

"Antigen binding moiety" refers to a polypeptide or a portion of a polypeptide that specifically binds to an antigenic determinant. An antigen binding moiety can direct, for example, the entity to which it is attached, such as a cytokine or a second antigen binding moiety, to a target site, for example, to a specific type of tumor cell or tumor stroma bearing the antigenic determinant. Antigen binding moieties include antibodies and fragments thereof. Examples of antigen binding moieties include an antigen binding domain of an antibody comprising an antibody heavy chain variable region and an antibody light chain variable region. An antigen binding moiety can include antibody constant regions. Useful heavy chain constant regions can include any of the five isotypes: a, Ii, E, y, or μ. Useful light chain constant regions can include any of the two isotypes K and A.

"Polypeptide" refers to a molecule composed of monomers (amino acids) linearly linked by amide bonds (also known as peptide bonds). The term "polypeptide" refers to any chain of two or more amino acids and does not refer to a specific length of the product. Thus, peptides, dipeptides, tripeptides, oligopeptides, "protein," "amino acid chain," or any other term used to refer to a chain of two or more amino acids, are included within the definition of "polypeptide," and the term "polypeptide" may be used instead of, or interchangeably with any of these terms. The term "polypeptide" is also intended to refer to the products of post-expression modifications of the polypeptide including, for example, glycosylation, acetylation, phosphorylation, amidation, derivatization by known protecting/blocking groups, proteolytic cleavage, and/or modification by non-naturally occurring amino acids. A polypeptide may be derived from a natural biological source or produced by recombinant technology but is not necessarily translated from a designated nucleic acid sequence. A polypeptide may be generated in any manner, including by recombinant methods or by chemical synthesis. A polypeptide may have, for example, more than 100 amino acids, more than 200 amino acids, more than 500 amino acids, more than 1,000 amino acids, or more than 2,000 amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations and are referred to as unfolded.

"Vector" or "expression vector" is synonymous with "expression construct" and refers to a DNA molecule that is used to introduce and direct the expression of a specific gene to which it is operably associated in a target cell. A vector can be a self-replicating nucleic acid structure as well as a vector incorporated into the genome of a host cell into which it has been introduced. An expression vector can comprise an expression cassette. Expression vectors allow transcription of large amounts of stable mRNA. Once an expression vector is inside the target cell, the ribonucleic acid molecule or protein that is encoded by the gene is produced by the cellular transcription and/or translation machinery. An expression vector can comprise an expression cassette that comprises polynucleotide sequences that encode an IL-7Rα ligand or IL-7Rα ligand construct provided by the present disclosure.

"Host cell," "host cell line," and "host cell culture" refer to cells into which are exogenous nucleic acid has been introduced, including the progeny of such cells. Host cells include, for example, "transformants" and "transformed cells," which include the primary transformed cell and progeny derived from the primary transformed cell without regard to the number of passages.

"Antibody" encompasses various antibody structures including, for example, monoclonal antibodies, polyclonal antibodies, multi-specific antibodies such as bispecific antibodies, and antibody fragments that exhibit a desired antigen binding activity.

"Full-length antibody," "intact antibody," and "whole antibody" refers to an antibody having a structure substantially similar to a native antibody structure or having heavy chains that contain both Fab and Fc regions.

"Antibody fragment" refers to a molecule other than an intact antibody that comprises a portion of an intact antibody that binds the antigen to which the intact antibody binds. Examples of antibody fragments include Fv, Fab, Fab', Fab'-SH, F(ab')2, diabodies, linear antibodies, single-chain antibody molecules such as scFv, and multi-specific antibodies formed from antibody fragments. Diabodies are antibody fragments with two antigen binding sites that may be bivalent or bispecific. Antibody fragments can be made by various techniques, including but not limited to proteolytic digestion of an intact antibody as well as production by recombinant host cells such as *E. coli* or phage.

"Fab" or "Fab region" refers to a polypeptide that comprises the VH, CHI, VL, and CL immunoglobulin domains, generally on two different polypeptide chains such as VH-CHl on one chain and VL-CL on the other. Fab may refer to this region in isolation, or this region in the context of a bispecific antibody. In the context of a Fab, the Fab comprises an Fv region in addition to the CHI and CL domains.

"Fv" or "Fv fragment" or "Fv region" refers to a polypeptide that comprises the VL and VH domains of an antibody. Fv regions can be formatted as both Fabs (generally two different polypeptides that also include the constant regions) and scFvs, where the vi and vh domains are combined (generally with a linker as discussed) to form an scFv.

"Single chain Fv" or "scFv" refers to a variable heavy domain covalently attached to a variable light domain, generally using a scFv linker as discussed herein, to form a scFv or scFv domain. A scFv domain can be in either orientation from N- to C-terminus.

"Fc" or "Fc region" or "Fc chain" refers to polypeptide comprising the constant region of an antibody, in some instances, excluding all or a portion of the first constant region immunoglobulin domain (e.g., CHI) or a portion thereof, and in some cases, further excluding all or a portion of the hinge. Thus, an Fc can refer to the last two constant region immunoglobulin domains (e.g., CH2 and CH3) of lgA, IgD, and IgG, the last three constant region immunoglobulin domains of IgE and IgM, and optionally, all or a portion of the flexible hinge N-terminal to these domains. For IgA and IgM, Fc may include the J chain. For IgG, the Fc chain comprises immunoglobulin domains CH2 and CH3 (Cy2 and Cy3), and optionally all or a portion of the hinge region between CHI (Cy1) and CH2 (Cy2). Although the boundaries of the Fc region may vary, the human IgG heavy chain Fc region is usually defined to include residues E216, C226, or A231 to its carboxyl-terminus, wherein the numbering is according to the EU index as in Kabat. An amino acid modification can be made to the Fc region, for example to alter binding to one or more FcyR or to the FcRn. In EU numbering for human IgG1, the CH2-CH3 domain comprises amino acids 231 to 447, and the hinge is 216 to 230. Thus, the definition of Fc chain includes both amino acids 231-447 (CH2-CH3) or 216-447 (hinge-CH2-CH3), or fragments thereof. An Fc fragment can contain fewer amino acids from either or both of the N- and C-termini that retains the ability to form a dimer with another Fc chain or Fc fragment as can be detected using standard methods, generally based on size (e.g., non-denaturing chromatography, size exclusion chromatography, etc.). Human IgG Fc chains are of particular use, and can be the Fc chain from human IgG1, IgG2 or IgG4.

"Heavy constant region" refers to the CH1-hinge-CH2-CH3 portion of an antibody or fragments thereof, excluding the variable heavy domain; in EU numbering of human IgG1, such as amino acids 118-447. "Heavy chain constant region fragment" refers to a heavy chain constant region that contains fewer amino acids from either or both of the N- and C-termini that retains the ability to form a dimer with another heavy chain constant region.

"Immunoglobulin molecule" refers to a protein having the structure of a naturally occurring antibody. For example, immunoglobulins of the IgG class are heterotetrameric glycoproteins of about 150,000 Da, composed of two light chains and two heavy chains that are bonded together through disulfide bonds. From N- to C-terminus, each heavy chain has a variable region (VH), also called a variable heavy domain or a heavy chain variable domain, followed by three constant domains (CHI, CH2, and CH3), also called a heavy chain constant region. Similarly, from N- to C-terminus, each light chain has a variable region (VL), also called a variable light domain or a light chain variable domain, followed by a constant light (CL) domain, also called a light chain constant region. The heavy chain of an immunoglobulin may be assigned to one of five classes, called a (IgA), Ii (IgD), E (IgE), y (IgG), or μ (IgM), some of which may be further divided into subclasses, e.g., γ1 (IgG1), γ2 (IgG2), γ3 (IgG3), γ4 (gG4), α1 (IgA1) and α2 (IgA2). The light chain of an immunoglobulin may be assigned to one of two types, kappa (k) or lambda (L), based on the amino acid sequence of its constant domain. An immunoglobulin essentially consists of two Fab molecules and an Fc chain, linked via the immunoglobulin hinge region.

"Immunoconjugate" refers to a polypeptide molecule that includes at least one IL-7Rα ligand and at least one antigen binding moiety. An immunoconjugate can comprise at least one IL-7Rα ligand, and at least two antigen binding moieties. An immunoconjugate can comprise at least one IL-7Rα ligand and two antigen binding moieties joined by one or more linker sequences. An antigen binding moiety can be joined to the IL-7Rα ligand by a variety of interactions and in a variety of configurations.

"Linker" refers to a moiety that binds one compound to another compound. Linkers can include IL-7Rα ligand linkers, tandem IL-7Rα ligand linkers, and IL-7Rα ligand construct linkers. A linker can be a synthetic linker. A linker can be an amino acid linker. In general, linkers provided by the present disclosure facilitate the ability of an IL-7Rα ligand to interact with IL-7R, to bind to IL-7R with high affinity, and/or to activate IL-7R. A linker can comprise a peptide or a non-peptide. Non-peptide linkers include those containing, for example, a triazole moiety derived from a Cu(I) catalyzed reaction of alkyne and azide functionalities.

An IL-7Rα ligand linker refers to a moiety that binds at least one IL-7R ligand such as an IL-7Rα ligand and/or an Rγc ligand to another IL-7R ligand. A linker can bind to another IL-7R ligand which can be the same IL-7R ligand or a different IL-7R ligand. A linker can also bind to one or more additional moieties that provide a desired physiological function. A linker can be divalent or multivalent. A linker can be hydrolytically stable or may include a physiologically hydrolyzable or enzymatically degradable or cleavable linkage. A linker can bind IL-7R ligands to form dimers, trimers, or higher order multi-ligand peptides (heteromers) and compounds.

A ligand linker can be divalent or multivalent. A ligand linker can be hydrolytically stable or can include a physiologically hydrolyzable or enzymatically degradable ligand linkage. A ligand linker can bind IL-7Rα ligands to form dimers, trimers, or higher order multi-ligand peptides (heteromers) and compounds. A ligand linker can be a peptidyl ligand linker or a chemical ligand linker. An IL-7Rαγc ligand refers to a moiety comprising at least one IL-7Rα ligand and at least one Rγc ligand.

A "flexible linker" refers to a peptidyl linker comprising flexible amino acids such as glycine and serine. A flexible linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from glycine and serine. Examples of flexible linkers include $(G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), or $(GGGGS)_n$ (SEQ ID NO: 9384) where n can be an integer from 1 to 20; $(G)_n$ (SEQ ID NO: 9385), $(GS)_n$ (SEQ ID NO: 9386), $(GGS)_n$ (SEQ ID NO: 9387), $(GGGS)_n$ (SEQ ID NO: 9388), or $(GGGGS)_n$ (SEQ ID NO: 9389) where n can be an integer from 1 to 10; or $(G)_n$ (SEQ ID NO: 9390), $(GS)_n$ (SEQ ID NO: 9391), $(GGS)_n$ (SEQ ID NO: 9392), $(GGGS)_n$ (SEQ ID NO: 9393), or $(GGGGS)_n$ (SEQ ID NO: 9394) where n can be an integer from 1 to 5. (A flexible linker can have the amino acid sequence, for example, (GGGGS) (SEQ ID NO: 9395), $(GGGGS)_2$ (SEQ ID NO: 9396), $(GGGGS)_3$ (SEQ ID NO: 9397), $(GGGGS)_4$ (SEQ ID NO: 9398), (GG) (SEQ ID NO: 9399), (GGG) (SEQ ID NO: 9400), (GGGGG) (SEQ ID NO: 9401), (GGS) (SEQ ID NO: 9402), (GGGS) (SEQ ID NO: 9403), (GGGGSGG) (SEQ ID NO: 9404), $(GGS)_2$ (SEQ ID NO: 9405), $(G)_5$ (SEQ ID NO: 9406), or $(GS)_{10}$ (SEQ ID NO: 9407).

A "rigid linker" refers to a peptidyl linker that is proline rich and can include other amino acids such as alanine, lysine, and/or glutamic acid. A rigid linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from proline, alanine, lysine, and glutamic acid. A rigid linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from proline and alanine. A rigid linker can have the sequence $(P)_n$ (SEQ ID NO: 9420) or $(PA)_n$ (SEQ ID NO: 9421), where n is an integer from 1 to 20. A rigid linker can have the sequence $(P)_n$ (SEQ ID NO: 9422) or $(PA)_n$ (SEQ ID NO: 9423), where n is an integer from 1 to 10. A rigid linker can have the sequence $(P)_n$ (SEQ ID NO: 9424) or $(PA)_n$ (SEQ ID NO: 9425), where n is an integer from 1 to 5. A rigid linker can have the sequence $(PA)_5$ (SEQ ID NO: 9426), $(PA)_7$ (SEQ ID NO: 9427). or $(PA)_{10}$ (SEQ ID NO: 9428).

"Protein" refers to at least two covalently attached amino acids, which includes proteins, polypeptides, oligopeptides and peptides. In addition, polypeptides that make up the antibodies may include synthetic derivatization of one or more side chains or termini, glycosylation, PEGylation, circular permutation, cyclization, linkers to other molecules, fusion to proteins or protein domains, and addition of peptide tags or labels. When a biologically functional molecule comprises two or more proteins, each protein may be referred to as a "monomer" or as a "subunit" or as a "domain"; and the biologically functional molecule may be referred to as a "complex."

"Binding affinity" of a compound such as an IL-7Rα ligand or an IL-7Rα ligand construct refers to the $IC_{50}$ as determined using, for example, a method described in the examples such as using phage ELISA competition assays.

"Amino acid sequence similarity" refers to an amino acid sequence in which one or more amino acids of the amino has been replaced with a chemically similar amino acid. Examples of chemically similar amino acids include (a) amino acids having a small hydrophobic side chain such as alanine (A), glycine (G), proline (P), serine (S), or threonine (T); (b) amino acids having a hydroxyl-containing side chain such as serine (S), threonine (T), or tyrosine (Y); (c) amino acids having an acidic side chain such as aspartate (D) or glutamate (E); (d) amino acids having a polar-neutral side chain such as histidine (H), asparagine (N), glutamine (Q), serine (S), threonine (T), or tyrosine (Y); (e) amino acids having a basic side chain such as arginine (R), lysine (K), or histidine (H); (f) amino acids having a large hydrophobic side chain such as isoleucine (I), leucine (L), methionine (M), valine (V), phenylalanine (F), tyrosine (Y), or tryptophan (W); and (g) amino acids having an aromatic side chain comprising phenylalanine (F), histidine (H), tryptophan (W), or tyrosine (Y). A chemically similar amino acid can comprise a naturally occurring amino acid or a non-natural amino acid.

"Percent (%) sequence similarity" is determined by comparing the number of amino acids that are the same in a subject binding compound and a reference binding compound. A binding compound provided by the present disclosure can comprise, for example, greater than 70%, greater than 80%, or greater than 90% sequence similarity to a reference binding compound. For example, based on a reference binding compound having SEQ ID NO: 1130, binding compounds having SEQ-ID NOS: 1131-1136, have either 1, 2, 3, 4, or 5 amino acid in which an amino acid of the reference peptide has been substituted or replaced with the amino acid, alanine. Binding compounds having SEQ ID NOS: 1131-1136 are characterized by a 95%, 90%, 85%, 80%, 75%, or 70% sequence similarity, respectively, to the amino acid sequence of the reference peptide.

```
                                        SEQ ID NO: 1130
Y P C W L A R V G E L C D L D S G D V H

SEQ ID NO: 1131
A P C W L A R V G E L C D L D S G D V H

SEQ ID NO: 1132
A P C A L A R V G E L C D L D S G D V H

SEQ ID NO: 1133
A P C A L A A V G E L C D L D S G D V H

SEQ ID NO: 1134
A P C A L A A V G A L C D L D S G D V H
```

```
                                                SEQ ID NO: 1135
        A P C A L A A V G A L C D L A S G D V H

SEQ ID NO: 1136
        A P C A L A A V G A L C D L A A G D V H
```

A binding compound provided by the present disclosure can have an amino acid sequence in which from 1 to 5 amino acids of a reference amino acid sequence is substituted with another amino acid.

For example, a binding compound derived from a reference binding compound can have from 1 to 5 amino acid substitutions, from 1 to 4, from 1 to 3, or from 1 to 2 amino acid substitutions. For example, a binding compound derived from a reference binding compound can have 1 amino acid substitution, 2 amino acid substitutions, 3 amino acid substitutions, 4 amino acid substitutions, or 5 amino acid substitutions.

An amino acid substitution can be independent of the other amino acid substitutions.

Each amino acid substitution can independently be a conservative amino acid substitution or a non-conservative amino acid substitution.

A conservative amino acid substitution refers to one of the following amino acid substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

For example, a reference binding compound can have the amino acid sequence of SEQ ID NO: 1120:

```
                                                SEQ ID NO: 1120
        Y W C W M A Q V G E L C D L

SEQ ID NO: 1121
        Y H C W M A Q V G E L C D L

SEQ ID NO: 1122
        Y H C W M G Q V G E L C D L

SEQ ID NO: 1123
        Y H C W M G Q M G E L C D L

SEQ ID NO: 1124
        Y H C W M G Q M G E L C E L

SEQ ID NO: 1125
        Y H C W M G Q M G E L C E M
```

Binding compounds having SEQ ID NOS: 1121-1125 represent binding compounds in which the reference binding compound having SEQ ID NO: 1120 has been substituted with from 1 to 5 conservative amino acid substitutions, respectively.

A binding compound provided by the present disclosure can comprise a truncated binding compound. A truncated binding compound refers to a binding compound in which from 1 to 5 amino acids have independently been removed from the N-terminus, the C-terminus, or from both the N-terminus and the C-terminus of the corresponding reference binding compound. A truncated binding compound derived from the corresponding reference binding compound can independently have from 1 to 5 amino acids, such as from 1 to 4 amino acids, from 1 to 3 amino acids, or from 1 to 2 amino acids independently removed from the N-terminus, the C-terminus, or from both the N-terminus and the C-terminus of the reference binding compound. A truncated binding compound derived from the corresponding reference binding compound can independently have 1 amino acid, 2 amino acids, 3 amino acids, 4 amino acids, or 5 amino acids removed from the N-terminus, the C-terminus, or from both the N-terminus and the C-terminus of the reference binding compound.

For example, a reference binding compound can have the amino acid sequence of SEQ ID NO: 1100. Examples of truncated binding compounds derived from the reference binding compound of SEQ ID NO: 1100 include truncated binding compounds of amino acid sequence of SEQ ID NOS: 1101-1108.

```
                                                SEQ ID NO: 1100
        M G F Y P C W T A Q L G E L C D L S V D

SEQ ID NO: 1101
        G F Y P C W T A Q L G E L C D L S V D

SEQ ID NO: 1102
        F Y P C W T A Q L G E L C D L S V D

SEQ ID NO: 1103
        Y P C W T A Q L G E L C D L S V D

SEQ ID NO: 1104
        M G F Y P C W T A Q L G E L C D L S V

SEQ ID NO: 1105
        M G F Y P C W T A Q L G E L C D L S

SEQ ID NO: 1106
        M G F Y P C W T A Q L G E L C D L

SEQ ID NO: 1107
        G F Y P C W T A Q L G E L C D L S V

SEQ ID NO: 1108
        F Y P C W T A Q L G E L C D L
```

The truncated binding compounds of SEQ ID NOS: 1101-1103 have amino acids removed from the N-terminus of the reference binding compound; truncated binding compounds of SEQ ID NOS: 1104-1106 have amino acids removed from the C-terminus of the reference binding compound; and truncated binding compounds of SEQ ID NOS: 1107-1108 have amino acids removed from both the N-terminus and from the C-terminus of the reference binding compound.

As another example, a reference binding compound can comprise an amino acid sequence of Formula (A):

$$-X^{500}-X^{501}-C-X^{502}-X^{503}-X^{504}-X^{505}-X^{506}-X^{507}-X^{508}- \quad \text{(A)}$$
$$X^{509}-C-X^{510}-X^{511}-$$

where each —X— independently represents an amino acid. Amino acid sequences of Formula (A1)-(A5) represent truncated binding compounds derived from the reference binding compound comprising the amino acid sequence of Formula (A):

$-X^{501}-C-X^{502}-X^{503}-X^{504}-X^{505}-X^{506}-X^{507}-X^{508}-X^{509}-C-$ (A1)
$X^{510}-X^{511}-$ $-C-X^{502}-X^{503}-X^{504}-X^{505}-X^{506}-X^{507}-X^{508}-X^{509}-C-X^{510}-$ (A2)
$X^{511}-$ $-C-X^{502}-X^{503}-X^{504}-X^{505}-X^{506}-X^{507}-X^{508}-X^{509}-C-$ (A3)

$-X^{502}-X^{503}-X^{504}-X^{505}-X^{506}-X^{507}-X^{508}-X^{509}-C-X^{510}-$ (A4)

$-X^{502}-X^{503}-X^{504}-X^{505}-X^{506}-X^{507}-X^{508}-X^{509}-$ (A5)

A binding compound provided by the present disclosure can comprise an amino acid sequence in which from 1 to 3 glycines are independently bonded to the N-terminus, to the C-terminus, or to both the N-terminus and to the C-terminus of a reference binding compound.

For example, reference binding compound can have SEQ ID NO: 1110. Binding compounds having SEQ ID NOS: 1111-1113 have from 1 to 3 glycines bonded to the N-terminus of the reference binding compound, respectively; binding compounds having SEQ ID NOS: 1114-1116 have from 1 to 3 glycines bonded to the C-terminus of the reference binding compound, respectively; and binding compounds having SEQ ID NOS: 1117-1118 independently have 1 or 2 glycines bonded to both the N-terminus and to the C-terminus of the reference binding compound.

```
                                              SEQ ID NO: 1110
          K Y C G F A Q L G E L C V L

SEQ ID NO: 1111
        G K Y C G F A Q L G E L C V L

SEQ ID NO: 1112
      G G K Y C G F A Q L G E L C V L

SEQ ID NO: 1113
    G G G K Y C G F A Q L G E L C V L

SEQ ID NO: 1114
          K Y C G F A Q L G E L C V L G

SEQ ID NO: 1115
          K Y C G F A Q L G E L C V L G G

SEQ ID NO: 1116
          K Y C G F A Q L G E L C V L G G G

SEQ ID NO: 1117
        G K Y C G F A Q L G E L C V L G

SEQ ID NO: 1118
      G G K Y C G F A Q L G E L C V L G
```

A binding compound can comprise a truncated binding compound in which from 1 to 3 glycines are independently bonded to the N-terminus, to the C-terminus, or to both the N-terminus and to the C-terminus of a reference truncated binding compound.

Reference is now made in detail to certain embodiments of compounds, compositions, and methods. The disclosed embodiments are not intended to be limiting of the claims. To the contrary, the claims are intended to cover all alternatives, modifications, and equivalents.

The present disclosure is directed to IL-7Rα binding compounds including IL-7Rα ligands, IL-7Rα homomers, IL-7Rα-containing heteromers, and IL-7Rα ligand constructs.

IL-7Rα binding compounds provided by the present disclosure can be designed to interact with and/or bind to the IL-7Rα subunit such as the hIL-7Rα subunit. The small peptidyl IL-7Rα ligands, have an amino acid sequence that is unrelated to that of the natural cytokine, IL-7. Because the IL-7Rα ligands are small, for example from 5 to 30 amino acids, with very low immunogenic potential, the small peptidyl IL-7Rα ligands can be incorporated into compounds to enhance therapeutic efficacy.

IL-7Rα ligands can be identified from highly complex peptide diversity libraries such as phage display libraries, optimized by peptide synthesis, and can be combined with other ligands and constructs to facilitate interaction and/or binding of the IL-7Rα ligand with the IL-7Rα subunit and to provide therapeutic efficacy.

An IL-7Rα ligand provided by the present disclosure can bind to the human IL-7Rα subunit with an $IC_{50}$ of less than 100 μM, less than 10 μM, less than 1 μM, less than 100 nM, less than 10 nM, or less than 1 nM.

An IL-7Rα ligand can exhibit a binding affinity ($IC_{50}$) to the human IL-7Rα subunit, for example, from 1 pM to 100 μM, from 10 pM to 10 μM, from 100 pM to 1 μM, from 1 nM to 1 μM, or from 10 nM to 1 μM.

An IL-7Rα ligand provided by the present disclosure can bind to a mammalian IL-7Rα subunit with an $IC_{50}$ of less than 100 μM, less than 10 μM, less than 1 μM, less than 100 nM, less than 10 nM, or less than 1 nM.

An IL-7Rα ligand can bind to a mammalian IL-7Rα subunit with an $IC_{50}$ from 1 pM to 100 μM, from 10 pM to 10 μM, from 100 pM to 1 μM, from 1 nM to 1 μM, or from 10 nM to 1 μM.

An IL-7Rα ligand provided by the present disclosure can comprise an amino acid sequence encompassed by any one of Formula (1) to (9C).

An IL-7Rα ligand provided by the present disclosure can comprise an amino acid sequence of any SEQ ID NOS: 1-410 and 520-655.

An IL-7Rα ligand provided by the present disclosure can comprise an amino acid sequence of any one of SEQ ID NOS: 1-410 and 520-655 independently having one or more of the following conservative substitutions: amino acids having a small hydrophobic side chain comprising alanine (A), glycine (G), proline (P), serine (S) or threonine (T), or tyrosine (Y); amino acids having a hydroxyl-containing side chain comprising serine (S), threonine (T); amino acids having an acidic side chain comprising aspartate (D) or glutamate (E); amino acids having a polar neutral side chain comprising histidine (H), asparagine (N), glutamine (Q), serine (S), threonine (T), or tyrosine (Y); amino acids having a basic side chain comprising arginine (R), lysine (K), or histidine (H); amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An IL-7Rα ligand provided by the present disclosure can have greater than 70%, greater than 80%, or greater than 90% sequence similarity to any one of SEQ ID NOS: 1-410 and 520-655.

An IL-7Rα ligand can comprise an amino acid sequence of any one of SEQ ID NOS: 1-8, which are referred to as Family 1 IL-7Rα ligands.

An IL-7Rα ligand can comprise the amino acid sequence of Formula (1) (SEQ ID NO: 1) or a partial amino acid sequence of Formula (1) such as the amino acid sequence of Formula (1a) (SEQ ID NO: 2), or the amino acid sequence of Formula (1b) (SEQ ID NO: 3):

$-X^1-C-X^2-X^3-X^4-X^5-X^6-X^7-X^8-X^9-X^{10}-X^{11}-C-X^{12}-$ (1)

$-C-X^2-X^3-X^4-X^5-X^6-X^7-X^8-X^9-X^{10}-X^{11}-C-$ (1a)

$-X^2-X^3-X^4-X^5-X^6-X^7-X^8-X^9-X^{10}-X^{11}-$ (1b)

wherein the amino acid sequences of Formula (1), Formula (1a), and Formula (1b) are defined in the following paragraphs.

In IL-7Rα ligands of Formula (1)-(1b),
$X^1$ can be selected from an amino acid comprising a small hydrophobic side chain;
$X^2$ can be selected from an amino acid comprising a polar/neutral side chain and an amino acid comprising a large hydrophobic side chain;
$X^3$ can be selected from an amino acid comprising a large hydrophobic side chain;
$X^4$ can be selected from an amino acid comprising a large hydrophobic side chain;
$X^5$ can be selected from an amino acid comprising an acidic side chain;
$X^6$ can be selected from an amino acid comprising a large hydrophobic side chain;
$X^7$ can be selected from an amino acid comprising an acidic side chain;
$X^8$ can be selected from an amino acid comprising a small hydrophobic side chain;
$X^9$ can be an amino acid comprising a large hydrophobic side chain;
$X^{10}$ can be an amino acid comprising a large hydrophobic side chain;
$X^{11}$ can be selected from an amino acid comprising a small hydrophobic side chain and an amino acid comprising a large hydrophobic side chain; and
$X^{12}$ can be selected from an amino acid.

In IL-7Rα ligands of Formula (1)-(1b), $X^1$ can be selected from P, Q, S, T, and Y.

In IL-7Rα ligands of Formula (1)-(1b), $X^2$ can be selected from F, I, P, Q, and S.

In IL-7Rα ligands of Formula (1)-(1b), $X^3$ can be selected from H and V.

In IL-7Rα ligands of Formula (1)-(1b), $X^3$ can be H.

In IL-7Rα ligands of Formula (1)-(1b), $X^4$ can be selected from H, Q, W, and Y.

In IL-7Rα ligands of Formula (1)-(1b), $X^4$ can be W.

In IL-7Rα ligands of Formula (1)-(1b), $X^5$ can be selected from D and P.

In IL-7Rα ligands of Formula (1)-(1b), $X^5$ can be D.

In IL-7Rα ligands of Formula (1)-(1b), $X^6$ can be selected from E, I, L, and V.

In IL-7Rα ligands of Formula (1)-(1b), $X^6$ can be L.

In IL-7Rα ligands of Formula (1)-(1b), $X^7$ can be selected from D, E, and Q.

In IL-7Rα ligands of Formula (1)-(1b), $X^7$ can be E.

In IL-7Rα ligands of Formula (1)-(1b), $X^8$ can be selected from D, G, S, and T.

In IL-7Rα ligands of Formula (1)-(1b), $X^8$ can be T.

In IL-7Rα ligands of Formula (1)-(1b), $X^9$ can be L.

In IL-7Rα ligands of Formula (1)-(1b), $X^{10}$ can be selected from A, M, and L.

In IL-7Rα ligands of Formula (1)-(1b), $X^{10}$ can be L.

In IL-7Rα ligands of Formula (1)-(1b), $X^{11}$ can be selected from A, S and V.

In IL-7Rα ligands of Formula (1)-(1b), $X^{11}$ can be selected from S and V.

In IL-7Rα ligands of Formula (1)-(1b), $X^{12}$ can be selected from A, I, R, T, and V.

In IL-7Rα ligands of Formula (1)-(1b), the IL-7Rα ligand can be defined by any combination of variables as defined in the immediately preceding twenty (20) paragraphs.

In IL-7Rα ligands of Formula (1)-(1b),
$X^1$ can be selected from P, Q, S, T, and Y;
$X^2$ can be selected from F, I, P, Q, and S;
$X^3$ can be selected from H and V;
$X^4$ can be selected from H, Q, W, and Y;
$X^5$ can be selected from D and P;
$X^6$ can be selected from E, I, L, and V;
$X^7$ can be selected from D, E, and Q;
$X^8$ can be selected from D, G, S, and T;
$X^9$ can be L;
$X^{10}$ can be selected from A, M, and L;
$X^{11}$ can be selected from A, S, and V; and
$X^{12}$ can be selected from A, I, R, T, and V.

In IL-7Rα ligands of Formula (1)-(1b),
$X^1$ can be selected from P, Q, S, T, and Y;
$X^2$ can be selected from F, I, P, Q, and S;
$X^3$ can be H;
$X^4$ can be W;
$X^5$ can be D;
$X^6$ can be L;
$X^7$ can be E;
$X^8$ can be T;
$X^9$ can be L;
$X^{10}$ can be L;
$X^{11}$ can be selected from S and V; and
$X^{12}$ can be selected from A, I, R, T, and V.

In IL-7Rα ligands of Formula (1)-(1b),
$X^1$ can be selected from an amino acid;
$X^2$ can be selected from an amino acid;
$X^3$ can be H;
$X^4$ can be selected from an amino acid comprising an aromatic side chain;
$X^5$ can be D;
$X^6$ can be selected from an amino acid comprising a large hydrophobic side chain;
$X^7$ can be selected from D and E;
$X^8$ can be selected from an amino acid;
$X^9$ can be L;
$X^{10}$ can be selected from L and M;
$X^{11}$ can be selected from an amino acid; and
$X^{12}$ can be selected from an amino acid.

An IL-7Rα ligand can comprise the amino acid sequence of any one of SEQ ID NOS: 4-8:

```
                                       SEQ ID NO: 4
        P C F V Y P E E D L L V C R

SEQ ID NO: 5
        Q C I H W D I E T L L S C V

SEQ ID NO: 6
        S C S H W D V E S L A V C T

SEQ ID NO: 7
        T C Q H Q D L Q G L L A C I

SEQ ID NO: 8
        Y C P H H D L D T L M S C A
```

An IL-7Rα ligand can comprise an amino acid sequence selected from any one of SEQ ID NOS: 1-8, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 1-8, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An IL-7Rα ligand can comprise a truncated amino acid sequence of any one of SEQ ID NOS: 1-8.

IL-7Rα ligands of SEQ ID NOS: 4-8 exhibited an affinity to the hIL-7Rα subunit of less than 100 μM.

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 1-8.

An IL-7Rα ligand can comprise an amino acid sequence of any one of SEQ ID NOS: 9-21, which are referred to as Family 2 IL-7Rα ligands.

An IL-7Rα ligand can comprise the amino acid sequence of Formula (2) (SEQ ID NO: 9) or a partial amino acid sequence of Formula (2) such as an amino acid sequence of Formula (2a) (SEQ ID NO: 10), an amino acid sequence of Formula (2b) (SEQ ID NO: 11), an amino acid sequence of Formula (2c) (SEQ ID NO: 12), or an amino acid sequence of Formula (2d) (SEQ ID NO: 13):

$$-X^{21}-X^{22}-X^{23}-C-X^{24}-X^{25}-X^{26}-X^{27}-X^{28}-X^{29}-X^{30}-X^{31}-C-X^{32}-X^{33}-X^{34}- \quad (2)$$

$$X^{22}-X^{23}-C-X^{24}-X^{25}-X^{26}-X^{27}-X^{28}-X^{29}-X^{30}-X^{31}-C-X^{32}-X^{33}- \quad (2a)$$

$$X^{23}-C-X^{24}-X^{25}-X^{26}-X^{27}-X^{28}-X^{29}-X^{30}-X^{31}-C-X^{32}- \quad (2b)$$

$$-C-X^{24}-X^{25}-X^{26}-X^{27}-X^{28}-X^{29}-X^{30}-X^{31}-C- \quad (2c)$$

$$X^{24}-X^{25}-X^{26}-X^{27}-X^{28}-X^{29}-X^{30}-X^{31}- \quad (2d)$$

wherein, $X^{21}$ can be selected from an amino acid comprising a large hydrophobic side chain;

$X^{22}$ can be selected from an amino acid comprising an acidic side chain, an amino acid comprising a small hydrophobic side chain, and an amino acid comprising a large hydrophobic side chain;

$X^{23}$ can be selected from an amino acid comprising a large hydrophobic side chain;

$X^{24}$ can be selected from an amino acid;

$X^{25}$ can be selected from an amino acid comprising an acidic side chain and an amino acid comprising a large hydrophobic side chain;

$X^{26}$ can be selected from an amino acid comprising an acidic side chain and an amino acid comprising a large hydrophobic side chain;

$X^{27}$ can be P;

$X^{28}$ can be G;

$X^{29}$ can be selected from an amino acid comprising a small hydrophobic side chain and an amino acid comprising a large hydrophobic side chain;

$X^{30}$ can be selected from an amino acid comprising a small hydrophobic side chain and an amino acid comprising a large hydrophobic side chain;

$X^{31}$ can be selected from an amino acid comprising an acidic side chain, an amino acid comprising a polar/neutral side chain, and an amino acid comprising a large hydrophobic side chain;

$X^{32}$ can be selected from an amino acid;

$X^{33}$ can be selected from an amino acid comprising a polar/neutral side chain and an amino acid comprising an aromatic side chain; and $X^{34}$ can be selected from an amino acid comprising a polar/neutral side chain and an amino acid comprising a large hydrophobic side chain.

In IL-7Rα ligands of Formula (2)-(2d), $X^{21}$ can be selected from D, I, R, S, V, and Y.

In IL-7Rα ligands of Formula (2)-(2d), $X^{21}$ can be selected from D and V.

In IL-7Rα ligands of Formula (2)-(2d), $X^{22}$ can be selected from D, E, P, W, and Y.

In IL-7Rα ligands of Formula (2)-(2d), $X^{22}$ can be selected from P, W, and Y.

In IL-7Rα ligands of Formula (2)-(2d), $X^{23}$ can be selected from A, E, L, S, and W.

In IL-7Rα ligands of Formula (2)-(2d), $X^{23}$ can be selected from L and W.

In IL-7Rα ligands of Formula (2)-(2d), $X^{24}$ can be selected from A, D, R, S, T, and Y.

In IL-7Rα ligands of Formula (2)-(2d), $X^{24}$ can be selected from D, R, and T.

In IL-7Rα ligands of Formula (2)-(2d), $X^{25}$ can be selected from D, E, L, M, P, and T.

In IL-7Rα ligands of Formula (2)-(2d), $X^{25}$ can be L.

In IL-7Rα ligands of Formula (2)-(2d), $X^{26}$ can be selected from A, D, G, L, N, V, and W.

In IL-7Rα ligands of Formula (2)-(2d), $X^{26}$ can be D.

In IL-7Rα ligands of Formula (2)-(2d), $X^{27}$ can be P.

In IL-7Rα ligands of Formula (2)-(2d), $X^{28}$ can be G.

In IL-7Rα ligands of Formula (2)-(2d), $X^{29}$ can be selected from D, G, L, S, T, W, and Y.

In IL-7Rα ligands of Formula (2)-(2d), $X^{29}$ can be selected from G and S.

In IL-7Rα ligands of Formula (2)-(2d), $X^{30}$ can be selected from A, D, F, L, P, T, and V.

In IL-7Rα ligands of Formula (2)-(2d), $X^{30}$ can be L.

In IL-7Rα ligands of Formula (2)-(2d), $X^{31}$ can be selected from D, E, F, H, Q, R, V, and Y.

In IL-7Rα ligands of Formula (2)-(2d), $X^{31}$ can be Q.

In IL-7Rα ligands of Formula (2)-(2d), $X^{32}$ can be selected from A, E, L, Q, S, and V.

In IL-7Rα ligands of Formula (2)-(2d), $X^{32}$ can be selected from A and V.

In IL-7Rα ligands of Formula (2)-(2d), $X^{33}$ can be selected from D, F, H, I, S, T, V, and W.

In IL-7Rα ligands of Formula (2)-(2d), $X^{33}$ can be W.

In IL-7Rα ligands of Formula (2)-(2d), $X^{34}$ can be selected from F, I, L, M, Q, R, S, and T.

In IL-7Rα ligands of Formula (2)-(2d), $X^{34}$ can be F.

In IL-7Rα ligands of Formula (2)-(2d), the IL-7Rα ligand can be defined by any combination of variables as defined in the immediately preceding twenty-six (26) paragraphs.

In IL-7Rα ligands of Formula (2)-(2d),
$X^{21}$ can be selected from I and V;
$X^{22}$ can be selected from P, W, and Y;
$X^{23}$ can be selected from L and W;
$X^{24}$ can be selected from an amino acid;
$X^{25}$ can be selected from L and M;
$X^{26}$ can be D;
$X^{27}$ can be P;
$X^{28}$ can be G;
$X^{29}$ can be an amino acid;
$X^{30}$ can be selected from F, L, and V;
$X^{31}$ can be an amino acid;
$X^{32}$ can be an amino acid;
$X^{33}$ can be selected from F, H, and W; and
$X^{34}$ can be selected from F, I, L, and M.

In IL-7Rα ligands of Formula (2)-(2d),
$X^{21}$ can be V;
$X^{22}$ can be P;
$X^{23}$ can be W;
$X^{24}$ can be selected from an amino acid;
$X^{25}$ can be L;
$X^{26}$ can be D;
$X^{27}$ can be P;
$X^{28}$ can be G;
$X^{29}$ can be an amino acid;
$X^{30}$ can be selected from F, I, L, M, V, Y, and W;
$X^{31}$ can be an amino acid;
$X^{32}$ can be an amino acid;
$X^{33}$ can be selected from F, H, W, and Y; and
$X^{34}$ can be selected from F, I, L, M, V, Y, and W.

An IL-7Rα ligand can comprise the amino acid sequence of any one of SEQ ID NOS: 14-21:

```
                                SEQ ID NO: 14
D W L C R T D P G Y L D C V S F

SEQ ID NO: 15
D W L C R P G P G L L V C Q W F

SEQ ID NO: 16
I P W C T L W P G G P E C Q T L

SEQ ID NO: 17
R Y E C A D L P G G L H C E F R

SEQ ID NO: 18
S Y A C D M N P G W D F C S D T

SEQ ID NO: 19
V P W C S L D P G S V Q C V H S

SEQ ID NO: 20
V D W C D L A P G D F R C A W M

SEQ ID NO: 21
V P W C T L D P G S T Q C A V I
```

An IL-7Rα ligand can comprise an amino acid sequence selected from any one of SEQ ID NOS: 9-21, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 9-21, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An IL-7Rα ligand can comprise a truncated amino acid sequence of any one of SEQ ID NOS: 9-21.

An IL-7Rα ligand of any one of SEQ ID NOS: 9-21 exhibited direct binding to the hIL-7Rα subunit of less than 100 μM as determined by phage ELISA assays.

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 9-21.

An IL-7Rα ligand can comprise an amino acid sequence of any one of SEQ ID NOS: 22-49, which are referred to as Family 3A IL-7Rα ligands.

An IL-7Rα ligand can comprise the amino acid sequence of Formula (3) (SEQ ID NO: 22) or a partial amino acid sequence of Formula (3) such as the amino acid sequence of Formula (3a) (SEQ ID NO: 23), the amino acid sequence of Formula (3b) (SEQ ID NO: 24), the amino acid sequence of Formula (3c) (SEQ ID NO: 25), or the amino acid sequence of Formula (3d) (SEQ ID NO: 26):

$$-X^{41}-X^{42}-X^{43}-C-X^{44}-X^{45}-X^{46}-X^{47}-X^{48}-X^{49}-X^{50}-X^{51}-C-X^{52}- \quad (3)$$

$$X^{53}-$$
$$-X^{42}-X^{43}-C-X^{44}-X^{45}-X^{46}-X^{47}-X^{48}-X^{49}-X^{50}-X^{51}-C-X^{52}-X^{53}- \quad (3a)$$

$$-X^{43}-C-X^{44}-X^{45}-X^{46}-X^{47}-X^{48}-X^{49}-X^{50}-X^{51}-C-X^{52}- \quad (3b)$$

$$-C-X^{44}-X^{45}-X^{46}-X^{47}-X^{48}-X^{49}-X^{50}-X^{51}-C- \quad (3c)$$

$$-X^{44}-X^{45}-X^{46}-X^{47}-X^{48}-X^{49}-X^{50}-X^{51}- \quad (3d)$$

wherein,
$X^{41}$ can be selected from an amino acid comprising a large hydrophobic side chain;
$X^{42}$ can be selected from an amino acid comprising a large hydrophobic side chain;
$X^{43}$ can be selected from an amino acid comprising a small hydrophobic side chain and an amino acid comprising a large hydrophobic side chain;
$X^{44}$ can be selected from an amino acid comprising an acidic side chain, an amino acid comprising a hydroxyl side chain, and an amino acid comprising a large hydrophobic side chain;
$X^{45}$ can be selected from an amino acid comprising a large hydrophobic side chain;
$X^{46}$ can be selected from an amino acid comprising a small hydrophobic side chain, an amino acid comprising an acidic side chain, an amino acid comprising a polar/neutral side chain, and an amino acid comprising a basic side chain;
$X^{47}$ can be selected from an amino acid comprising a small hydrophobic side chain or an amino acid comprising a polar/neutral side chain;

$X^{48}$ can be selected from an amino acid comprising polar/neutral side chain and an amino acid comprising a large hydrophobic side chain;
$X^{49}$ can be selected from an amino acid comprising a basic side chain;
$X^{50}$ can be selected from an amino acid comprising a large hydrophobic side chain;
$X^{51}$ can be selected from an amino acid comprising a basic side chain;
$X^{52}$ can be selected from an amino acid comprising a small hydrophobic side chain; and
$X^{53}$ can be selected from an amino acid comprising polar/neutral side chain and an amino acid comprising a large hydrophobic side chain.

In IL-7Rα ligands of Formula (3)-(3d), $X^{41}$ can be can be L.

In IL-7Rα ligands of Formula (3)-(3d), $X^{42}$ can be selected from I, L, and V.

In IL-7Rα ligands of Formula (3)-(3d), $X^{43}$ is selected from A, C, D, E, F, H, Q, and Y.

In IL-7Rα ligands of Formula (3)-(3d), $X^{43}$ can be selected from F, Q, and Y.

In IL-7Rα ligands of Formula (3)-(3d), $X^{44}$ can be selected from A, I, M, Q, T, and V.

In IL-7Rα ligands of Formula (3)-(3d), $X^{45}$ can be selected from D, E, F, H, I, N, S, T, V, and Y.

In IL-7Rα ligands of Formula (3)-(3d), $X^{45}$ can be selected from E, T, and V.

In IL-7Rα ligands of Formula (3)-(3d), $X^{46}$ can be selected from F, I, L, and W.

In IL-7Rα ligands of Formula (3)-(3d), $X^{46}$ can be selected from F and I.

In IL-7Rα ligands of Formula (3)-(3d), $X^{47}$ can be selected from A, D, E, G, H, K, L, R, and S.

In IL-7Rα ligands of Formula (3)-(3d), $X^{47}$ can be selected from G, H, and P.

In IL-7Rα ligands of Formula (3)-(3d), $X^{48}$ can be selected from A, E, G, N, P, Q, S, T, and V.

In IL-7Rα ligands of Formula (3)-(3d), $X^{48}$ can be selected from G and N.

In IL-7Rα ligands of Formula (3)-(3d), $X^{49}$ can be selected from F, G, I, Q, T, V, and Y.

In IL-7Rα ligands of Formula (3)-(3d), $X^{49}$ can be selected from G, Q, and Y.

In IL-7Rα ligands of Formula (3)-(3d), $X^{50}$ can be selected from K and R.

In IL-7Rα ligands of Formula (3)-(3d), $X^{51}$ can be selected from I, L, and V.

In IL-7Rα ligands of Formula (3)-(3d), $X^{51}$ can be selected from L and V.

In IL-7Rα ligands of Formula (3)-(3d), $X^{52}$ can be R.

In IL-7Rα ligands of Formula (3)-(3d), $X^{53}$ can be selected from A, G, L, Q, S, and T.

In IL-7Rα ligands of Formula (3)-(3d), $X^{53}$ can be selected from A, S, and T.

In IL-7Rα ligands of Formula (3)-(3d), the IL-7Rα ligand can be defined by any combination of variables as defined in the immediately preceding twenty-one (21) paragraphs.

In IL-7Rα ligands of Formula (3)-(3d),
$X^{41}$ can be L;
$X^{42}$ can be selected from I, L, and V;
$X^{43}$ can be selected from A, C, D, E, F, H, Q, and Y;
$X^{43}$ can be selected from F, Q, and Y;
$X^{44}$ can be selected from A, I, M, Q, T, and V;
$X^{45}$ can be selected from D, E, F, H, I, N, S, T, V, and Y;
$X^{45}$ can be selected from E, T, and V;
$X^{46}$ can be selected from F, I, L, and W;
$X^{46}$ can be selected from F and I;
$X^{47}$ can be selected from A, D, E, G, H, K, L, P, R, and S;
$X^{47}$ can be selected from G, H, and P;
$X^{48}$ can be selected from A, E, G, N, P, Q, S, T, and V;
$X^{48}$ can be selected from G and N;
$X^{49}$ can be selected from F, G, I, Q, T, V, and Y;
$X^{49}$ can be selected from G, Q, and Y;
$X^{50}$ can be selected from K and R;
$X^{51}$ can be selected from I, L, and V;
$X^{51}$ can be selected from L and V;
$X^{52}$ can be R;
$X^{53}$ can be selected from A, G, L, Q, S, and T; and
$X^{53}$ can be selected from A, S, and T.

In IL-7Rα ligands of Formula (3)-(3d),
$X^{41}$ can be L;
$X^{42}$ can be selected from I, L, and V;
$X^{43}$ can be selected from F, Q, and Y;
$X^{44}$ can be selected from A, I, M, Q, T, and V;
$X^{45}$ can be selected from E, T, and V;
$X^{46}$ can be selected from F and I;
$X^{47}$ can be selected from G, H, and P;
$X^{48}$ can be selected from G and N;
$X^{49}$ can be selected from G, Q, and Y;
$X^{50}$ can be selected from K and R;
$X^{51}$ can be selected from L and V;
$X^{52}$ can be R; and
$X^{53}$ can be selected from A, S, and T.

In IL-7Rα ligands of Formula (3)-(3d),
$X^{41}$ can be L;
$X^{42}$ can be selected from an amino acid comprising a large hydrophobic side chain;
$X^{43}$ can be Y;
$X^{44}$ can be selected from an amino acid comprising a large hydrophobic side chain;
$X^{45}$ can be selected from an amino acid comprising a large hydrophobic side chain;
$X^{46}$ can be F;
$X^{47}$ can be H;
$X^{48}$ can be G;
$X^{49}$ can be Y;
$X^{50}$ can be K;
$X^{51}$ can be V;
$X^{52}$ can be R; and
$X^{53}$ can be S.

An IL-7Rα ligand can comprise the amino acid sequence of any one of SEQ ID NOS: 27-49:

```
                                    SEQ ID NO: 27
     F W C E V F A G I K V C R P

SEQ ID NO: 28
     I F C A I F H G V K V C R S

SEQ ID NO: 29
     I Y C Q I F D T V K I C R S

SEQ ID NO: 30
     I Y C M E F L S G R V C R G

SEQ ID NO: 31
     I A C A N F H G T R V C R T

SEQ ID NO: 32
     I Y C A F L S G Y K T C R S

SEQ ID NO: 33
     I D C F D F G F T K V C R P
```

-continued

```
                                  SEQ ID NO: 34
I Y C A Y L H G Y K V C R K

SEQ ID NO: 35
I Y C I S I S N H K V C R A

SEQ ID NO: 36
L Y C M V F P A G K V C R S

SEQ ID NO: 37
L Q C V V I R N Q K L C R G

SEQ ID NO: 38
L E C V T I K G Y K L C R L

SEQ ID NO: 39
L D C I Y F G Q I K V C R A

SEQ ID NO: 40
L Y C A E L H G F R V C R L

SEQ ID NO: 41
L Q C T V I N S F K L C R L

SEQ ID NO: 42
L Y C I E S Y N L R S C R I

SEQ ID NO: 43
V Y C A E I G E Y R V C R Q

SEQ ID NO: 44
V Q C V F I A P Y K L C R S

SEQ ID NO: 45
V H C M S F E G Q R V C R A

SEQ ID NO: 46
V F C I D F P V Y R V C R A

SEQ ID NO: 47
V F C T T I H G Q K L C R A

SEQ ID NO: 48
V V C A Y F W D Q K V C R E

SEQ ID NO: 49
V Y C A K F D E V K V C R A
```

An IL-7Rα ligand can comprise an amino acid sequence selected from any one of SEQ ID NOS: 22-49, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 22-49, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 22-49.

An IL-7Rα ligand can comprise a truncated amino acid sequence of any one of SEQ ID NOS: 22-49.

An IL-7Rα ligand of any one of SEQ ID NOS: 27-49 exhibited a direct binding to the hIL-7Rα subunit of less than 100 μM as determined by phage ELISA assays.

An IL-7Rα ligand can comprise an amino acid sequence of any one of SEQ ID NOS: 50-73, which are referred to as Family 3B IL-7Rα ligands.

An IL-7Rα ligand can comprise the amino acid sequence of Formula (4) (SEQ ID NO: 50) or a partial amino acid sequence of Formula (4) such as the amino acid sequence of Formula (4a) (SEQ ID NO: 51), the amino acid sequence of Formula (4b) (SEQ ID NO: 52), the amino acid sequence of Formula (4c) (SEQ ID NO: 53), the amino acid sequence of Formula (4d) (SEQ ID NO: 54), or the amino acid sequence of Formula (4e) (SEQ ID NO: 55):

$$-X^{61}-X^{62}-X^{63}-X^{64}-C-X^{65}-X^{66}-X^{67}-X^{68}-X^{69}-X^{70}-X^{71}-X^{72}-C- \quad (4)$$
$$X^{73}-X^{74}-X^{75}-$$

$$-X^{62}-X^{63}-X^{64}-C-X^{65}-X^{66}-X^{67}-X^{68}-X^{69}-X^{70}-X^{71}-X^{72}-C-X^{73}- \quad (4a)$$
$$X^{74}-X^{75}-$$

$$-X^{63}-X^{64}-C-X^{65}-X^{66}-X^{67}-X^{68}-X^{69}-X^{70}-X^{71}-X^{72}-C-X^{73}-X^{74}- \quad (4b)$$

$$-X^{64}-C-X^{65}-X^{66}-X^{67}-X^{68}-X^{69}-X^{70}-X^{71}-X^{72}- \quad (4c)$$

$$-C-X^{65}-X^{66}-X^{67}-X^{68}-X^{69}-X^{70}-X^{71}-X^{72}-C- \quad (4d)$$

$$-X^{65}-X^{66}-X^{67}-X^{68}-X^{69}-X^{70}-X^{71}-X^{72}- \quad (4e)$$

wherein, $X^{61}$ can be an amino acid comprising a large hydrophobic side chain;

$X^{62}$ can be selected from an amino acid comprising a small hydrophobic side chain and an amino acid comprising a polar/neutral side chain;

$X^{63}$ can be an amino acid comprising a large hydrophobic side chain;

$X^{64}$ can be an amino acid comprising a large hydrophobic side chain;

$X^{65}$ can be selected from an amino acid comprising a large hydrophobic side chain;

$X^{66}$ can be selected from an amino acid comprising a basic side chain and an amino acid comprising a polar/neutral side chain;

$X^{67}$ can be selected from an amino acid comprising a large hydrophobic side chain;

$X^{68}$ can be selected from an amino acid comprising a small hydrophobic side chain;

$X^{69}$ can be selected from an amino acid comprising a small hydrophobic side chain;

$X^{70}$ can be selected from an amino acid;

$X^{71}$ can be selected from an amino acid comprising a basic side chain and an amino acid comprising a large hydrophobic side chain;

$X^{72}$ can be selected from an amino acid comprising a large hydrophobic side chain;

$X^{73}$ can be selected from an amino acid comprising a basic side chain;

$X^{74}$ can be selected from an amino acid comprising a small hydrophobic side chain; and $X^{75}$ can be selected from an amino acid comprising a polar/neutral side chain.

In IL-7Rα ligands of Formula (4)-(4e), $X^{61}$ can be V.
In IL-7Rα ligands of Formula (4)-(4e), $X^{62}$ can be selected from G, H, N, P, Q, R, S, and V.
In IL-7Rα ligands of Formula (4)-(4e), $X^{62}$ can be P.
In IL-7Rα ligands of Formula (4)-(4e), $X^{63}$ can be selected from C, I, and V.
In IL-7Rα ligands of Formula (4)-(4e), $X^{63}$ can be V.
In IL-7Rα ligands of Formula (4)-(4e), $X^{64}$ can be selected from A, F, V, and Y.
In IL-7Rα ligands of Formula (4)-(4e), $X^{64}$ can be Y.
In IL-7Rα ligands of Formula (4)-(4e), $X^{65}$ can be selected from A, I, L, M, N, and V.
In IL-7Rα ligands of Formula (4)-(4e), $X^{66}$ can be selected from E, H, K, L, N, Q, R, and T.
In IL-7Rα ligands of Formula (4)-(4e), $X^{67}$ can be selected from F, G, L, and P.
In IL-7Rα ligands of Formula (4)-(4e), $X^{67}$ can be L.
In IL-7Rα ligands of Formula (4)-(4e), $X^{68}$ can be selected from G and P.
In IL-7Rα ligands of Formula (4)-(4e), $X^{68}$ can be P.
In IL-7Rα ligands of Formula (4)-(4e), $X^{69}$ can be selected from G and I.
In IL-7Rα ligands of Formula (4)-(4e), $X^{69}$ can be G.
In IL-7Rα ligands of Formula (4)-(4e), $X^{70}$ can be selected from G, H, Q, S, T, and Y.
In IL-7Rα ligands of Formula (4)-(4e), $X^{71}$ can be selected from K, R, V, and Y.
In IL-7Rα ligands of Formula (4)-(4e), $X^{72}$ can be selected from N, P, and V.
In IL-7Rα ligands of Formula (4)-(4e), $X^{72}$ can be V.
In IL-7Rα ligands of Formula (4)-(4e), $X^{73}$ can be R.
In IL-7Rα ligands of Formula (4)-(4e), $X^{74}$ can be selected from A, G, L, N, S, and V.
In IL-7Rα ligands of Formula (4)-(4e), $X^{74}$ can be S.
In IL-7Rα ligands of Formula (4)-(4e), $X^{75}$ can be selected from H, L, R, S, T, and Y.
In IL-7Rα ligands of Formula (4)-(4e), the IL-7Rα ligand can be defined by any combination of variables as defined in the immediately preceding twenty-three (23) paragraphs.
In IL-7Rα ligands of Formula (4)-(4e),
$X^{61}$ can be V;
$X^{62}$ can be selected from G, H, N, P, Q, R, S, and V;
$X^{63}$ can be selected from C, I, and V;
$X^{64}$ can be selected from A, F, V, and Y;
$X^{65}$ can be selected from A, I, L, M, N, and V;
$X^{66}$ can be selected from E, H, K, L, N, Q, R, and T;
$X^{67}$ can be selected from F, G, L, and P;
$X^{68}$ can be selected from G and P;
$X^{69}$ can be selected from G and I;
$X^{70}$ can be selected from G, H, Q, S, T, and Y;
$X^{71}$ can be selected from K, R, V, and Y;
$X^{72}$ can be selected from N, P, and V;
$X^{73}$ can be R;
$X^{74}$ can be selected from A, G, L, N, S, and V; and
$X^{75}$ can be selected from H, L, R, S, T, and Y.
In IL-7Rα ligands of Formula (4)-(4e),
$X^{61}$ can be V;
$X^{62}$ can be P;
$X^{63}$ can be V;
$X^{64}$ can be Y;
$X^{65}$ can be selected from A, I, L, M, N, and V;
$X^{66}$ can be selected from E, H, K, L, N, Q, R, and T;
$X^{67}$ can be L;
$X^{68}$ can be P;
$X^{69}$ can be G;
$X^{70}$ can be selected from G, H, Q, S, T, and Y;
$X^{71}$ can be selected from K, R, V, and Y;
$X^{72}$ can be selected from N, P, and V;
$X^{72}$ can be V;
$X^{73}$ can be R;
$X^{74}$ can be S; and
$X^{75}$ can be selected from H, L, R, S, T, and Y.
In IL-7Rα ligands of Formula (4)-(4e),
$X^{61}$ can be V;
$X^{62}$ can be P;
$X^{63}$ can be V;
$X^{64}$ can be Y;
$X^{65}$ can be selected from an amino acid comprising a large hydrophobic side chain;
$X^{66}$ can be selected from an amino acid;
$X^{67}$ can be L;
$X^{68}$ can be P;
$X^{69}$ can be G;
$X^{70}$ can be selected from an amino acid;
$X^{71}$ can be selected from an amino acid comprising a basic side chain;
$X^{72}$ can be V;
$X^{73}$ can be R;
$X^{74}$ can be S; and
$X^{75}$ can be selected from an amino acid comprising a hydroxyl-containing side chain.

An IL-7Rα ligand can comprise the amino acid sequence of any one of SEQ ID NOS: 56-73:

```
                                          SEQ ID NO: 56
    G V Y C L L G P G T V P C R A L

SEQ ID NO: 57
    H V Y C L H G P G S V P C R S H

SEQ ID NO: 58
    H V Y C L H G P G S V P C R S H

SEQ ID NO: 59
    L V F C E M F P G G R V C R G E

SEQ ID NO: 60
    N I A C M R F P G G Y V C R N Y

SEQ ID NO: 61
    N I A C M R F P G G Y V C R N Y

SEQ ID NO: 62
    P V Y C M E L P G H R V C R G S

SEQ ID NO: 63
    P I Y C A K L P G G Y N C R

SEQ ID NO: 64
    P V V C A T L P G G Y V C R V T

SEQ ID NO: 65
    P V Y C M E L P G H R V C R G S

SEQ ID NO: 66
    Q V Y C Q V F P G F K A C R T R

SEQ ID NO: 67
    R V F C I N L P G Q R V C R L S

SEQ ID NO: 68
    R I F C V T L P G G K S C R T F

SEQ ID NO: 69
    R I Y C M V L P G G Y N C R A N

SEQ ID NO: 70
    S V F C V Q F P G Y K V C R S S

SEQ ID NO: 71
    T I A C V N L P G G Y V C R E Y
```

-continued

```
                                        SEQ ID NO: 72
         V V Y C I Q F P G Y K V C R S R

SEQ ID NO: 73
         V Q C V T N L P G I Q K V C R S
```

An IL-7Rα ligand can comprise an amino acid sequence selected from any one of SEQ ID NOS: 50-73, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 50-73, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 50-73.

An IL-7Rα ligand can comprise a truncated amino acid sequence of any one of SEQ ID NOS: 50-73.

An IL-7Rα ligand of any one of SEQ ID NOS: 56-73 exhibited a direct binding to the hIL-7Rα subunit of less than 100 μM as determined by phage ELISA assays.

An IL-7Rα ligand can comprise an amino acid sequence of any one of SEQ ID NOS: 74-82, which are referred to as Family 4 IL-7Rα ligands.

An IL-7Rα ligand can comprise the amino acid sequence of Formula (5) (SEQ ID NO: 74) or a partial amino acid sequence of Formula (5) such as the amino acid sequence of Formula (5a) (SEQ ID NO: 75), the amino acid sequence of Formula (5b) (SEQ ID NO: 76), or the amino acid sequence of Formula (5c) (SEQ ID NO: 77):

$-X^{81}-X^{82}-X^{83}-X^{84}-X^{85}-X^{86}-X^{87}-X^{88}-X^{89}-X^{90}-X^{91}-X^{92}-X^{93}-X^{94}-X^{95}-$ (5)

$-X^{82}-X^{83}-X^{84}-X^{85}-X^{86}-X^{87}-X^{88}-X^{89}-X^{90}-X^{91}-X^{92}-X^{93}-X^{94}-$ (5a)

$-X^{83}-X^{84}-X^{85}-X^{86}-X^{87}-X^{88}-X^{89}-X^{90}-X^{91}-X^{92}-X^{93}-$ (5b)

$-X^{84}-X^{85}-X^{86}-X^{87}-X^{88}-X^{89}-X^{90}-X^{91}-X^{92}-$ (5c)

wherein,
$X^{81}$ can be selected from C, K, R, S, and V;
$X^{82}$ can be selected from C and S;
$X^{83}$ can be selected from K, L, R, and S;
$X^{84}$ can be selected from G, H, R, S, and T;
$X^{85}$ can be selected from G, R, T, V, and W;
$X^{86}$ can be selected from D, F, P, and R;
$X^{87}$ can be selected from L, M, and W;
$X^{88}$ can be selected from D, E, and V;
$X^{89}$ can be selected from L, N, P, and S;
$X^{90}$ can be selected from D, F, L, and W;
$X^{91}$ can be selected from L, N, and W;
$X^{92}$ can be selected from G, I, L, and Q;
$X^{93}$ can be selected from C, F, N, and S;
$X^{94}$ can be selected from C, I and R; and
$X^{95}$ can be selected from L and N.

An IL-7Rα ligand can comprise the amino acid sequence of any one of SEQ ID NOS: 78-82:

```
                                        SEQ ID NO: 78
         C S R R V P W V L D N I F C

SEQ ID NO: 79
         K C S S R R L D L W W L N C N

SEQ ID NO: 80
         R C K G G F M V P F L G S C L

SEQ ID NO: 81
         S C L H W D L E S L L Q C I

SEQ ID NO: 82
         V C R T T R L D N W W G C R
```

An IL-7Rα ligand can comprise an amino acid sequence selected from any one of SEQ ID NOS: 74-82, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 74-82, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 74-82.

An IL-7Rα ligand can comprise a truncated amino acid sequence of any one of SEQ ID NOS: 74-82.

An IL-7Rα ligand of any one of SEQ ID NOS: 78-82 exhibited a direct binding to the hIL-7Rα subunit of less than 100 μM as determined by phage ELISA assays.

An IL-7Rα ligand can comprise an amino acid sequence selected from any one of SEQ ID NOS: 83-105:

ANRVHVQQGFWW  SEQ ID NO: 83

FVFCGQDYQMCKNF  SEQ ID NO: 84

GDSQVAYWSPYA  SEQ ID NO: 85

HCRLQKPGFHRSSCY  SEQ ID NO: 86

HCRLQKPGFHRSSC  SEQ ID NO: 87

ISCYFPAGLKPLCRY  SEQ ID NO: 88

KEAGGPPGGEGGR  SEQ ID NO: 89

KLCRGGWVWLDWCVN  SEQ ID NO: 90

LVCWTHWSNQRLCRT  SEQ ID NO: 91

LHCWEHWLGTKICRL  SEQ ID NO: 92

LVFCEMFPGGRVCRGE  SEQ ID NO: 93

NVFCVYFDSKVCRTR  SEQ ID NO: 94

NVFCVYFDSKVCRT  SEQ ID NO: 95

QNCYELRDAALMCAM  SEQ ID NO: 96

QVCCIHFPGRMVCRAC  SEQ ID NO: 97

SRDVRELIVIAS  SEQ ID NO: 98

TVLSFEAWQILF  SEQ ID NO: 99

VCCVDLNSVKICRRC  SEQ ID NO: 100

WRICCINPGLRVCRQC  SEQ ID NO: 101

YRQLCLDALLSI  SEQ ID NO: 102

YWACSSGMNLCRWN  SEQ ID NO: 103

YMACSSGLSLCRLS  SEQ ID NO: 104

YLACSTTLGKCRWN  SEQ ID NO: 105

An IL-7Rα ligand can comprise an amino acid sequence selected from any one of SEQ ID NOS: 83-105, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 83-105, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 83-105.

An IL-7Rα ligand can comprise a truncated amino acid sequence of any one of SEQ ID NOS: 83-105.

An hIL-7Rα ligand of any one of SEQ ID NOS: 83-105 exhibited a direct binding to the hIL-7Rα subunit of less than 100 μM as determined by phage ELISA assays.

An IL-7Rα ligand can comprise an amino acid sequence of any one of SEQ ID NOS: 106-183, which are included in the Family 1 IL-7Rα ligands.

An IL-7Rα ligand can comprise the amino acid sequence of Formula (6) (SEQ ID NO: 106) or a partial amino acid sequence of Formula (6) such as the amino acid sequence of Formula (6a) (SEQ ID NO: 107), the amino acid sequence of Formula (6b) (SEQ ID NO: 108), the amino acid sequence of Formula (6c) (SEQ ID NO: 109), the amino acid sequence of Formula (6d) (SEQ ID NO: 110), the amino acid sequence of Formula (6e) (SEQ ID NO: 111):

$$-X^{101}-X^{102}-X^{103}-X^{104}-X^{105}-X^{106}-X^{107}-C-X^{108}-X^{109}-X^{110}-X^{111}-X^{112}-X^{113}-X^{114}-X^{115}-X^{116}-X^{117}-C-X^{118}- \quad (6)$$

$$X^{119}-X^{120}-X^{121}-X^{122}-X^{123}-X^{124}-X^{125}-X^{126}-$$

$$-X^{105}-X^{106}-X^{107}-C-X^{108}-X^{109}-X^{110}-X^{111}-X^{112}-X^{113}-X^{114}-X^{115}-X^{116}-X^{117}-C-X^{118}-X^{119}-X^{120}- \quad (6a)$$

$$-X^{106}-X^{107}-C-X^{108}-X^{109}-X^{110}-X^{111}-X^{112}-X^{113}-X^{114}-X^{115}-X^{116}-X^{117}-C-X^{118}-X^{119}- \quad (6b)$$

$$-X^{107}-C-X^{108}-X^{109}-X^{110}-X^{111}-X^{112}-X^{113}-X^{114}-X^{115}-X^{116}-X^{117}-C-X^{118} \quad (6c)$$

$$-C-X^{108}-X^{109}-X^{110}-X^{111}-X^{112}-X^{113}-X^{114}-X^{115}-X^{116}-X^{117}-C- \quad (6d)$$

$$-X^{108}-X^{109}-X^{110}-X^{111}-X^{112}-X^{113}-X^{114}-X^{115}-X^{116}-X^{117}- \quad (6e)$$

wherein, $X^{101}$ can be selected from an amino acid comprising a small hydrophobic side chain;

$X^{102}$ can be selected from an amino acid;

$X^{103}$ can be selected from an amino acid comprising a polar/neutral side chain;

$X^{104}$ can be selected from an amino acid comprising a polar neutral side chain and an amino acid comprising a basic side chain;

$X^{105}$ can be selected from an amino acid comprising a small hydrophobic side chain;

$X^{106}$ can be selected from an amino acid comprising a small hydrophobic side chain;

$X^{107}$ can be selected from an amino acid comprising a polar/neutral hydrophobic side chain, and amino acid comprising an acidic side chain, and an amino acid comprising an aromatic side chain;

$X^{108}$ can be selected from an amino acid comprising a large hydrophobic side chain;

$X^{109}$ can be selected from an amino acid comprising a basic side chain;

$X^{110}$ can be selected from an amino acid comprising a large hydrophobic side chain;

$X^{111}$ can be selected from an amino acid comprising an acidic side chain;

$X^{112}$ can be selected from an amino acid comprising a large hydrophobic side chain;

$X^{113}$ can be selected from an amino acid comprising an acidic side chain;

$X^{114}$ can be selected from an amino acid comprising a hydroxyl-containing side chain;

$X^{115}$ can be selected from an amino acid comprising a large hydrophobic side chain;

$X^{116}$ can be selected from an amino acid comprising a large hydrophobic side chain;

$X^{117}$ can be selected from an amino acid comprising a small hydrophobic side chain;

$X^{118}$ can be selected from an amino acid comprising a large hydrophobic side chain;

$X^{119}$ can be selected from an amino acid comprising an acidic side chain, an amino acid comprising a polar/neutral side chain, and an amino acid comprising a basic side chain;

$X^{120}$ can be selected from an amino acid;

$X^{121}$ can be selected from an amino acid;

$X^{122}$ can be selected from an amino acid;

$X^{123}$ can be selected from an amino acid;

$X^{124}$ can be selected from an amino acid;

$X^{125}$ can be selected from an amino acid; and $X^{126}$ can be selected from an amino acid.

In IL-7Rα ligands of Formula (6)-(6e), $X^{101}$ can be selected from E, G, I, Q, R, S, and T.

In IL-7Rα ligands of Formula (6)-(6e), $X^{102}$ can be selected from A, D, G, H, M, R, S, V, and W.

In IL-7Rα ligands of Formula (6)-(6e), $X^{103}$ can be selected from F, G, K, L, Q, S, and Y.

In IL-7Rα ligands of Formula (6)-(6e), $X^{104}$ can be selected from I, K, M, N, P, Q, R, S, T, and V.

In IL-7Rα ligands of Formula (6)-(6e), $X^{105}$ can be selected from F, G, K, L, M, Q, R, S, T, and W.

In IL-7Rα ligands of Formula (6)-(6e), $X^{105}$ can be G.

In IL-7Rα ligands of Formula (6)-(6e), $X^{106}$ can be selected from A, D, E, F, G, I, K, L, M, R, S, T, and Y.

In IL-7Rα ligands of Formula (6)-(6e), $X^{106}$ can be G.

In IL-7Rα ligands of Formula (6)-(6e), $X^{107}$ can be selected from D, E, F, G, H, N, P, Q, R, and Y.

In IL-7Rα ligands of Formula (6)-(6e), $X^{107}$ can be selected from H, Q, and Y.

In IL-7Rα ligands of Formula (6)-(6e), $X^{108}$ can be selected from A, F, I, K, L, M, N, P, S, T, V, and Y.

In IL-7Rα ligands of Formula (6)-(6e), $X^{109}$ can be selected from G, H, K, and S.

In IL-7Rα ligands of Formula (6)-(6e), $X^{109}$ can be H.

In IL-7Rα ligands of Formula (6)-(6e), $X^{110}$ can be selected from F, I, K, L, S, and W.

In IL-7Rα ligands of Formula (6)-(6e), $X^{110}$ can be W.

In IL-7Rα ligands of Formula (6)-(6e), $X^{111}$ can be selected from D, E, and P.

In IL-7Rα ligands of Formula (6)-(6e), $X^{111}$ can be D.

In IL-7Rα ligands of Formula (6)-(6e), $X^{112}$ can be selected from I, F, L, and M.

In IL-7Rα ligands of Formula (6)-(6e), $X^{112}$ can be L.

In IL-7Rα ligands of Formula (6)-(6e), $X^{113}$ can be selected from D, E, G, Q, T, and Y.

In IL-7Rα ligands of Formula (6)-(6e), $X^{113}$ can be E.

In IL-7Rα ligands of Formula (6)-(6e), $X^{114}$ can be selected from Q, S, and T.

In IL-7Rα ligands of Formula (6)-(6e), $X^{114}$ can be S.

In IL-7Rα ligands of Formula (6)-(6e), $X^{115}$ can be selected from L, F, and S.

In IL-7Rα ligands of Formula (6)-(6e), $X^{115}$ can be L.

In IL-7Rα ligands of Formula (6)-(6e), $X^{116}$ can be selected from F, I, L, M, N, V, and W.

In IL-7Rα ligands of Formula (6)-(6e), $X^{116}$ can be L.

In IL-7Rα ligands of Formula (6)-(6e), $X^{117}$ can be selected from A, D, E, F, G, H, L, M, N, Q, R, S, W, and Y.

In IL-7Rα ligands of Formula (6)-(6e), $X^{117}$ can be selected from A and S.

In IL-7Rα ligands of Formula (6)-(6e), $X^{118}$ can be selected from F, I, K, L, M, Q, R, and V.

In IL-7Rα ligands of Formula (6)-(6e), $X^{118}$ can be V.

In IL-7Rα ligands of Formula (6)-(6e), $X^{119}$ can be selected from A, D, E, G, H, K, M, N, Q, R, S, and Y.

In IL-7Rα ligands of Formula (6)-(6e), $X^{119}$ can be R.

In IL-7Rα ligands of Formula (6)-(6e), $X^{120}$ can be selected from A, D, E, G, I, K, M, N, P, Q, R, S, T, and Y.

In IL-7Rα ligands of Formula (6)-(6e), $X^{121}$ can be selected from A, E, G, H, I, K, L, N, P, Q, R, S, and W.

In IL-7Rα ligands of Formula (6)-(6e), $X^{122}$ can be selected from A, E, F, I, K, L, P, R, S, and T.

In IL-7Rα ligands of Formula (6)-(6e), $X^{123}$ can be selected from D, E, F, G, I, L, M, N, R, W, and Y.

In IL-7Rα ligands of Formula (6)-(6e), $X^{124}$ can be selected from A, E, G, H, K, L, P, Q, R, S, T, and Y.

In IL-7Rα ligands of Formula (6)-(6e), $X^{125}$ can be E.

In IL-7Rα ligands of Formula (6)-(6e), $X^{126}$ can be A.

In IL-7Rα ligands of Formula (6)-(6e), the IL-7Rα ligand can be defined by any combination of variables as defined in the immediately preceding forty (40) paragraphs.

In IL-7Rα ligands of Formula (6)-(6e),
$X^{101}$ can be selected from E, G, I, Q, R, S, and T;
$X^{102}$ can be selected from A, D, G, H, M, R, S, V, and W;
$X^{103}$ can be selected from F, G, K, L, Q, S, and Y;
$X^{104}$ can be selected from I, K, M, N, P, Q, R, S, T, and V;
$X^{105}$ can be selected from F, G, K, L, M, Q, R, S, T, and W;
$X^{106}$ can be selected from A, D, E, F, G, I, K, L, M, R, S, T, and Y;
$X^{107}$ can be selected from D, E, F, G, H, N, P, Q, R, and Y;
$X^{108}$ can be selected from A, F, I, K, L, M, N, P, S, T, V, and Y;
$X^{109}$ can be selected from G, H, K, and S;
$X^{110}$ can be selected from F, I, K, L, S, and W;
$X^{111}$ can be selected from D, E, and P;
$X^{112}$ can be selected from I, F, L, and M;
$X^{113}$ can be selected from D, E, G, Q, T, and Y;
$X^{114}$ can be selected from Q, S, and T;
$X^{115}$ can be selected from F, L, and S;
$X^{116}$ can be selected from F, I, L, M, N, V, and W;
$X^{117}$ can be selected from A, D, E, F, G, H, L, M, N, Q, R, S, W, and Y;
$X^{118}$ can be selected from F, I, K, L, M, Q, R, and V;
$X^{119}$ can be selected from A, D, E, G, H, K, M, N, Q, R, S, and Y;
$X^{120}$ can be selected from A, D, E, G, I, K, M, N, P, Q, R, S, T, and Y;
$X^{121}$ can be selected from A, E, G, H, I, K, L, N, P, Q, R, S, and W;
$X^{122}$ can be selected from A, E, F, I, K, L, P, R, S, and T;
$X^{123}$ can be selected from D, E, F, G, I, L, M, N, R, W, and Y;
$X^{124}$ can be selected from A, E, G, H, K, L, P, Q, R, S, T, and Y;
$X^{125}$ can be E; and
$X^{126}$ can be A.

In IL-7Rα ligands of Formula (6)-(6e),
$X^{101}$ can be selected from E, G, I, Q, R, S, and T;
$X^{102}$ can be selected from A, D, G, H, M, R, S, V, and W;
$X^{103}$ can be selected from F, G, K, L, Q, S, and Y;
$X^{104}$ can be selected from I, K, M, N, P, Q, R, S, T, and V;
$X^{105}$ can be G;
$X^{106}$ can be G;
$X^{107}$ can be selected from H, Q, and Y;
$X^{108}$ can be selected from A, F, I, K, L, M, N, P, S, T, V, and Y;
$X^{109}$ can be H;
$X^{110}$ can be W;
$X^{111}$ can be D;
$X^{112}$ can be L;
$X^{113}$ can be E;
$X^{114}$ can be S;
$X^{115}$ can be L;
$X^{116}$ can be L;
$X^{117}$ can be selected from A and S;
$X^{118}$ can be V;
$X^{119}$ can be R;
$X^{120}$ can be selected from A, D, E, G, I, K, M, N, P, Q, R, S, T, and Y;
$X^{121}$ can be selected from A, E, G, H, I, K, L, N, P, Q, R, S, and W;
$X^{122}$ can be selected from A, E, F, I, K, L, P, R, S, and T;
$X^{123}$ can be selected from D, E, F, G, I, L, M, N, R, W, and Y;
$X^{124}$ can be selected from A, E, G, H, K, L, P, Q, R, S, T, and Y;
$X^{125}$ can be E; and
$X^{126}$ can be A.

In IL-7Rα ligands of Formula (6)-(6e),
$X^{107}$ can be selected from an amino acid comprising a large hydrophobic side chain;
$X^{108}$ can be selected from an amino acid comprising a basic side chain;
$X^{109}$ can be selected from H and K;
$X^{110}$ can be W;
$X^{111}$ can be D;
$X^{112}$ can be selected from I, L, and M;
$X^{113}$ can be selected from D and E;
$X^{114}$ can be selected from S and T;
$X^{115}$ can be selected from F and L;
$X^{116}$ can be selected from F, L, and M;
$X^{117}$ can be selected from A and S; and
$X^{118}$ can be selected from I and V.

In IL-7Rα ligands of Formula (6)-(6e),
$X^{107}$ can be selected from H, Q and Y;
$X^{108}$ can be selected from A, F, I, K, L, M, N, P, S, T, V, and Y;
$X^{109}$ can be selected from H and K;
$X^{110}$ can be W;
$X^{111}$ can be D;
$X^{112}$ can be selected from I, L, and M;
$X^{113}$ can be selected from D and E;
$X^{114}$ can be selected from S and T;
$X^{115}$ can be selected from F and L;
$X^{116}$ can be selected from F, L, and M;
$X^{117}$ can be selected from A and S; and
$X^{118}$ can be selected from I and V.

In IL-7Rα ligands of Formula (6)-(6e),
$X^{107}$ can be selected from H, Q, and Y;
$X^{108}$ can be selected from A, F, I, K, L, M, N, P, S, T, V, and Y;
$X^{109}$ can be H;
$X^{110}$ can be W;
$X^{111}$ can be D;
$X^{112}$ can be L;
$X^{113}$ can be E;
$X^{114}$ can be S;
$X^{115}$ can be L;
$X^{116}$ can be L;
$X^{117}$ can be selected from A and S; and
$X^{118}$ can be V.

An IL-7Rα ligand can comprise an amino acid sequence selected from any one of SEQ ID NOS: 112-183:

```
                                    SEQ ID NO: 112
    D S K Q E Q C F H W D L E S L L S C L

SEQ ID NO: 113
    D C M H W D L E S L L A C V

SEQ ID NO: 114
    D C I H W D L E S L L R C V

SEQ ID NO: 115
    D C Y H W D L E S L L A C L

SEQ ID NO: 116
    D C F H W D M E S L L R C V

SEQ ID NO: 117
    E C M H W D L E S L L A C V
```

EDFQGYQCFHWDIESLLSCI SEQ ID NO: 118

ECIHWDLESLLSCV SEQ ID NO: 119

FCMHWDMESLLACVQGAAMQ SEQ ID NO: 120

HCLHWDIETLMSCVYGNFEE SEQ ID NO: 121

HCNHWDFESLVSCVKDWSWS SEQ ID NO: 122

HCKHWDLESLLLCV SEQ ID NO: 123

HCKHWDIESLLSCVGIRLEP SEQ ID NO: 124

HCVHWDLESLLSCVNMQKLK SEQ ID NO: 125

HCIHWDLESLLACVQMHKGS SEQ ID NO: 126

HCMHWDMETLLECVRQWKIT SEQ ID NO: 127

HCIHWDLESLLSCVEDRRDR SEQ ID NO: 128

HCVHWDLESLLSCVNEPRFK SEQ ID NO: 129

HCNHWDLESLLSCVRNGAEQ SEQ ID NO: 130

HCIHWDLDSLLACVMGQRNQ SEQ ID NO: 131

HCMHSDMQTLFACMRDHIYA SEQ ID NO: 132

HCMHWDLESLLACV SEQ ID NO: 133

HCIHWDLESLLACVMGQRNQ SEQ ID NO: 134

HCVHWDLESLLDCVRRQPLK SEQ ID NO: 135

HCNHWDLESLLSCV SEQ ID NO: 136

HCFHWDLESLLACV SEQ ID NO: 137

HCIHWDMESLIACV SEQ ID NO: 138

HCVHWDLESLLSCV SEQ ID NO: 139

HCIHWDLDSLLSCV SEQ ID NO: 140

IHSSWAQCMHWDLESLISCV SEQ ID NO: 141

MGLQCTHWDFDSLMACKREL SEQ ID NO: 142

NCLHWDLESLLSCVSDLREG SEQ ID NO: 143

NMRHCLHWDMESLMACVNQW SEQ ID NO: 144

NCMHWDIESLLQCVRQIRDY SEQ ID NO: 145

QCVHWDLDTLFGCIREQLEL SEQ ID NO: 146

QGSRFTECMHWDIESLLSCI SEQ ID NO: 147

QCIHWDLESLLNCLRELKEP SEQ ID NO: 148

QCVHWDITTLLSCVKNLLDE SEQ ID NO: 149

QCFHWDFESLMSCV SEQ ID NO: 150

QCLHWDLESLLACV SEQ ID NO: 151

QCVHWDFESLLACV SEQ ID NO: 152

QMFGCIHWDLETLLMCVEKL SEQ ID NO: 153

QCIHWDLESLLSCVESERRL SEQ ID NO: 154

QGMNCSHWDLETLLDCMRTL SEQ ID NO: 155

QCIHWDIETLLSCV SEQ ID NO: 156

QCFHWDLESLLSCL SEQ ID NO: 157

QTMPCLHWDLESLLFCVKGL SEQ ID NO: 158

QCIHWDIETLLSCV SEQ ID NO: 159

QCLHWDLESLLACV SEQ ID NO: 160

QCVHWDLESLLYCV SEQ ID NO: 161

QCLHWDLESLLSCV SEQ ID NO: 162

QCLHWDLESLLSCV SEQ ID NO: 163

QCMHWDLESLLSCV SEQ ID NO: 164

QCLHWDLETLLACV SEQ ID NO: 165

RMYVRDQCISLDMDTFLSCL SEQ ID NO: 166

RRIHCMKWEFDTLMWCRGPQ SEQ ID NO: 167

RTRQCNHWDLESLLMCIQNL SEQ ID NO: 168

RLIQSPCMHWDLESLLLCV SEQ ID NO: 169

SAKVLKQCLHWDLESLLSCL SEQ ID NO: 170

SRRQCVKKDLGTFWSCFKAP SEQ ID NO: 171

```
                          SEQ ID NO: 172
S S S R L M Q C M H W D L E S L L Q C V

SEQ ID NO: 173
T V Q P S S H C F H W D I D S L L S C L

SEQ ID NO: 174
V R A Q C M H W D L E S L L S C V D R S

SEQ ID NO: 175
W G T K A Y C N H W D L E S L L A C V

SEQ ID NO: 176
W G Q C M H W D L E S L L S C V

SEQ ID NO: 177
Y C M H W D L E S L L W C V H R K E L E

SEQ ID NO: 178
Y C P H F D I D S L L D C V R Q S T W Y

SEQ ID NO: 179
Y C F H W D L E S L I S C V

SEQ ID NO: 180
Y C A H W D L E S L L S C V E G L S R S

SEQ ID NO: 181
Y C I H W D L E S L L S C V S Y N E R H

SEQ ID NO: 182
Y C F H W D L E T L M Q C V A K G S N R

SEQ ID NO: 183
Y C M H W D L E T L L A C V
```

An IL-7Rα ligand can comprise an amino acid sequence selected from any one of SEQ ID NOS: 106-183, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 106-183, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 106-183.

An IL-7Rα ligand can comprise a truncated amino acid sequence of any one of SEQ ID NOS: 106-183.

An IL-7Rα ligand of any one of SEQ ID NOS: 106-183 exhibited a direct binding to the hIL-7Rα subunit of less than 100 μM as determined by phage ELISA assays.

An IL-7Rα ligand can comprise an amino acid sequence of any one of SEQ ID NOS: 184-349, which are included in the Family 3A IL-7Rα ligands.

An IL-7Rα ligand can comprise the amino acid sequence of Formula (7) (SEQ ID NO: 184) or a partial amino acid sequence of Formula (7) such as the amino acid sequence of Formula (7a) (SEQ ID NO: 185), the amino acid sequence of Formula (7b) (SEQ ID NO: 186), the amino acid sequence of Formula (7c) (SEQ ID NO: 187), the amino acid sequence of Formula (7d) (SEQ ID NO: 188), or the amino acid sequence of Formula (7e) (SEQ ID NO: 189):

$$-X^{131}-X^{132}-X^{133}-X^{134}-X^{135}-X^{136}-X^{137}-X^{138}-X^{139}-C-X^{140}-X^{141}-X^{142}-X^{143}-X^{144}-X^{145}-X^{146}-X^{147}-C-X^{148}- \quad (7)$$
$$X^{149}-X^{150}-X^{151}-X^{152}-X^{153}-X^{154}-X^{155}-X^{156}-$$

$$-X^{137}-X^{138}-X^{139}-C-X^{140}-X^{141}-X^{142}-X^{143}-X^{144}-X^{145}-X^{146}-X^{147}-C-X^{148}-X^{149}-X^{150}- \quad (7a)$$

$$-X^{138}-X^{139}-C-X^{140}-X^{141}-X^{142}-X^{143}-X^{144}-X^{145}-X^{146}-X^{147}-C-X^{148}-X^{149}- \quad (7b)$$

$$-X^{139}-C-X^{140}-X^{141}-X^{142}-X^{143}-X^{144}-X^{145}-X^{146}-X^{147}-C-X^{148}- \quad (7c)$$

$$-C-X^{140}-X^{141}-X^{142}-X^{143}-X^{144}-X^{145}-X^{146}-X^{147}-C- \quad (7d)$$

$$-X^{140}-X^{141}-X^{142}-X^{143}-X^{144}-X^{145}-X^{146}-X^{147}- \quad (7e)$$

wherein,
$X^{131}$ can be selected from an amino acid;
$X^{132}$ can be selected from an amino acid;
$X^{133}$ can be selected from an amino acid;
$X^{134}$ can be selected from an amino acid;
$X^{135}$ can be selected from an amino acid;
$X^{136}$ can be selected from an amino acid;
$X^{137}$ can be selected from an amino acid comprising a large hydrophobic side chain;
$X^{138}$ can be selected from an amino acid comprising a small hydrophobic side chain;
$X^{139}$ can be selected from an amino acid comprising a large hydrophobic side chain;
$X^{140}$ can be selected from an amino acid comprising a large hydrophobic side chain and an amino acid comprising a small hydrophobic side chain;
$X^{141}$ can be selected from an amino acid comprising a large hydrophobic side chain;
$X^{142}$ can be selected from an amino acid comprising an acidic side chain;
$X^{143}$ can be selected from an amino acid comprising a small hydrophobic side chain;
$X^{144}$ can be selected from an amino acid comprising a small hydrophobic side chain;

$X^{145}$ can be selected from an amino acid comprising a small hydrophobic side chain;

$X^{146}$ can be selected from an amino acid comprising a large hydrophobic side chain;

$X^{147}$ can be selected from an amino acid comprising a polar/neutral side chain;

$X^{148}$ can be selected from an amino acid comprising a small hydrophobic side chain;

$X^{149}$ can be selected from an amino acid comprising an aromatic side chain;

$X^{150}$ can be selected from an amino acid comprising a large hydrophobic side chain;

$X^{151}$ can be selected from an amino acid comprising a polar/neutral side chain;

$X^{152}$ can be selected from an amino acid comprising a polar/neutral side chain;

$X^{153}$ can be selected from an amino acid comprising an acidic side chain and an amino acid comprising a polar/neutral side chain;

$X^{154}$ can be selected from an amino acid;

$X^{155}$ can be selected from an amino acid; and $X^{156}$ can be selected from an amino acid.

In IL-7Rα ligands of Formula (7)-(7e), $X^{131}$ can be selected from D, E, G, H, I, K, M, N, Q, R, S, T, V, W, and Y.

In IL-7Rα ligands of Formula (7)-(7e), $X^{131}$ can be G.

In IL-7Rα ligands of Formula (7)-(7e), $X^{132}$ can be selected from A, C, D, E, F, G, H, K, N, P, Q, R, S, T, V, and W.

In IL-7Rα ligands of Formula (7)-(7e), $X^{133}$ can be selected from E, F, G, H, I, K, L, M, N, Q, R, S, and W.

In IL-7Rα ligands of Formula (7)-(7e), $X^{134}$ can be selected from A, D, E, F, G, H, I, K, L, M, N, Q, R, S, T, V, W, and Y.

In IL-7Rα ligands of Formula (7)-(7e), $X^{134}$ can be selected from D, E, G, R, S, T, and W.

In IL-7Rα ligands of Formula (7)-(7e), $X^{134}$ can be G.

In IL-7Rα ligands of Formula (7)-(7e), $X^{135}$ can be selected from A, C, D, E, F, G, H, I, K, L, M, N, Q, R, S, T, V, and W.

In IL-7Rα ligands of Formula (7)-(7e), $X^{135}$ can be selected from G, R, S, and T.

In IL-7Rα ligands of Formula (7)-(7e), $X^{136}$ can be selected from A, D, E, F, G, H, I, K, L, M, P, Q, R, S, T, V, and Y.

In IL-7Rα ligands of Formula (7)-(7e), $X^{136}$ can be selected from G, R, S, T, and V.

In IL-7Rα ligands of Formula (7)-(7e), $X^{136}$ can be G.

In IL-7Rα ligands of Formula (7)-(7e), $X^{137}$ can be selected from D, I, L, and V.

In IL-7Rα ligands of Formula (7)-(7e), $X^{137}$ can be selected from I and V.

In IL-7Rα ligands of Formula (7)-(7e), $X^{138}$ can be selected from D, F, N, P, and R.

In IL-7Rα ligands of Formula (7)-(7e), $X^{138}$ can be P.

In IL-7Rα ligands of Formula (7)-(7e), $X^{139}$ can be selected from G, S, and W.

In IL-7Rα ligands of Formula (7)-(7e), $X^{139}$ can be W.

In IL-7Rα ligands of Formula (7)-(7e), $X^{140}$ can be selected from A, D, E, H, I, K, L, M, N, Q, R, S, T, and V.

In IL-7Rα ligands of Formula (7)-(7e), $X^{140}$ can be selected from L, M, S, and T.

In IL-7Rα ligands of Formula (7)-(7e), $X^{140}$ can be T.

In IL-7Rα ligands of Formula (7)-(7e), $X^{141}$ can be selected from D, L, and W.

In IL-7Rα ligands of Formula (7)-(7e), $X^{141}$ can be L.

In IL-7Rα ligands of Formula (7)-(7e), $X^{142}$ can be selected from A, D, H, Q, and W.

In IL-7Rα ligands of Formula (7)-(7e), $X^{142}$ can be D.

In IL-7Rα ligands of Formula (7)-(7e), $X^{143}$ can be P.

In IL-7Rα ligands of Formula (7)-(7e), $X^{144}$ can be G.

In IL-7Rα ligands of Formula (7)-(7e), $X^{145}$ can be selected from A, G, and S.

In IL-7Rα ligands of Formula (7)-(7e), $X^{145}$ can be S.

In IL-7Rα ligands of Formula (7)-(7e), $X^{146}$ can be selected from F, I, L, M, Q, V, and Y.

In IL-7Rα ligands of Formula (7)-(7e), $X^{146}$ can be L.

In IL-7Rα ligands of Formula (7)-(7e), $X^{147}$ can be selected from H, Q, and R.

In IL-7Rα ligands of Formula (7)-(7e), $X^{147}$ can be Q.

In IL-7Rα ligands of Formula (7)-(7e), $X^{148}$ can be selected from A, D, E, G, H, K, L, M, Q, S, T, V, and W.

In IL-7Rα ligands of Formula (7)-(7e), $X^{148}$ can be A.

In IL-7Rα ligands of Formula (7)-(7e), $X^{149}$ can be selected from F, R, W, and Y.

In IL-7Rα ligands of Formula (7)-(7e), $X^{149}$ can be W.

In IL-7Rα ligands of Formula (7)-(7e), $X^{150}$ can be selected from F, I, L, M, Q, S, V, W, and Y.

In IL-7Rα ligands of Formula (7)-(7e), $X^{150}$ can be L.

In IL-7Rα ligands of Formula (7)-(7e), $X^{151}$ can be selected from A, E, G, H, K, L, M, N, Q, R, S, T, and V.

In IL-7Rα ligands of Formula (7)-(7e), $X^{151}$ can be selected from R, S, and T.

In IL-7Rα ligands of Formula (7)-(7e), $X^{152}$ can be selected from A, D, E, G, H, I, K, L, M, N, Q, R, T, and Y.

In IL-7Rα ligands of Formula (7)-(7e), $X^{152}$ can be selected from G, K, N, R, and S.

In IL-7Rα ligands of Formula (7)-(7e), $X^{153}$ can be selected from A, D, E, F, G, H, I, K, L, M, N, Q, R, S, T, V, W and Y.

In IL-7Rα ligands of Formula (7)-(7e), $X^{154}$ can be selected from A, E, F, G, K, L, N, Q, R, V, W, and Y.

In IL-7Rα ligands of Formula (7)-(7e), $X^{154}$ can be selected from E, G, and K.

In IL-7Rα ligands of Formula (7)-(7e), $X^{155}$ can be selected from A, D, E, G, H, K, N, P, S, T, V, and W.

In IL-7Rα ligands of Formula (7)-(7e), $X^{155}$ can be selected from E, K, and S.

In IL-7Rα ligands of Formula (7)-(7e), $X^{156}$ can be selected from D, E, G, H, K, N, Q, R, S, V, and W.

In IL-7Rα ligands of Formula (7)-(7e), $X^{156}$ can be selected from G, K, and R.

In IL-7Rα ligands of Formula (7)-(7e), the IL-7Rα ligand can be defined by any combination of variables as defined in the immediately preceding fifty (50) paragraphs.

In IL-7Rα ligands of Formula (7)-(7e), $X^{131}$ can be selected from D, E, G, H, I, K, M, N, Q, R, S, T, V, W, and Y;

$X^{132}$ can be selected from A, C, D, E, F, G, H, K, N, P, Q, R, S, T, V, and W;

$X^{133}$ can be selected from E, F, G, H, I, K, L, M, N, Q, R, S, and W;

$X^{134}$ can be selected from A, D, E, F, G, H, I, K, L, M, N, Q, R, S, T, V, W, and Y;

$X^{135}$ can be selected from A, C, D, E, F, F, G, H, I, K, L, M, N, Q, R, S, T, V, and W;

$X^{136}$ can be selected from A, D, E, F, G, H, I, K, L, M, P, Q, R, S, T, V, and Y;

$X^{137}$ can be selected from D, I, L, and V;

$X^{138}$ can be selected from D, F, N, P, and R;

$X^{139}$ can be selected from G, S, and W;

$X^{140}$ can be selected from A, D, E, H, I, K, L, M, N, Q, R, S, T, and V;

$X^{141}$ can be selected from D, L, and W;
$X^{142}$ can be selected from A, D, H, Q, and W;
$X^{143}$ can be P;
$X^{144}$ can be G;
$X^{145}$ can be selected from A, G, and S;
$X^{146}$ can be selected from F, I, L, M, Q, V, and Y;
$X^{147}$ can be selected from H, Q, and R;
$X^{148}$ can be selected from A, D, E, G, H, K, L, M, Q, S, T, V, and W;
$X^{149}$ can be selected from F, R, W, and Y;
$X^{150}$ can be selected from F, I, L, M, Q, S, V, W, and Y;
$X^{151}$ can be selected from A, E, G, H, K, L, M, N, Q, R, S, T, and V;
$X^{152}$ can be selected from A, D, E, G, H, I, K, L, M, N, Q, R, T, and Y;
$X^{153}$ can be selected from A, D, E, F, G, H, I, K, L, M, N, Q, R, S, T, V, W, and Y;
$X^{154}$ can be selected from A, E, F, G, K, L, N, Q, R, V, W, and Y;
$X^{155}$ can be selected from A, D, E, G, H, K, N, P, S, T, V, and W; and
$X^{156}$ can be selected from D, E, G, H, K, N, Q, R, S, V, and W.

In IL-7Rα ligands of Formula (7)-(7e),
$X^{131}$ can be G;
$X^{132}$ can be selected from A, C, D, E, F, G, H, K, N, P, Q, R, S, T, V, and W;
$X^{133}$ can be selected from E, F, G, H, I, K, L, M, N, Q, R, S, and W;
$X^{134}$ can be selected from D, E, G, R, S, T, and W;
$X^{135}$ can be selected from G, R, S, and T;
$X^{136}$ can be selected from G, R, S, T, and V;
$X^{137}$ can be selected from I and V;
$X^{138}$ can be P;
$X^{139}$ can be W;
$X^{140}$ can be selected from L, M, S, and T;
$X^{141}$ can be L;
$X^{142}$ can be D;
$X^{143}$ can be P;
$X^{144}$ can be G;
$X^{145}$ can be S;
$X^{146}$ can be L;
$X^{147}$ can be Q;
$X^{148}$ can be A;
$X^{149}$ can be W;
$X^{150}$ can be L;
$X^{151}$ can be selected from R, S, and T;
$X^{152}$ can be selected from G, K, N, R, and S;
$X^{153}$ can be selected from A, D, E, F, G, H, I, K, L, M, N, Q, R, S, T, V, W, and Y;
$X^{154}$ can be selected from E, G, and K;
$X^{155}$ can be selected from E, K, and S; and
$X^{156}$ can be selected from G, K, and R.

In IL-7Rα ligands of Formula (7)-(7e),
$X^{131}$ can be G;
$X^{132}$ can be selected from A, C, D, E, F, G, H, K, N, P, Q, R, S, T, V, and W;
$X^{133}$ can be selected from E, F, G, H, I, K, L, M, N, Q, R, S, and W;
$X^{134}$ can be G;
$X^{135}$ can be selected from G, R, S, and T;
$X^{136}$ can be G;
$X^{137}$ can be selected from I and V;
$X^{138}$ can be P;
$X^{139}$ can be W;
$X^{140}$ can be T;
$X^{141}$ can be L;
$X^{142}$ can be D;
$X^{143}$ can be P;
$X^{144}$ can be G;
$X^{145}$ can be S;
$X^{146}$ can be L;
$X^{147}$ can be Q;
$X^{148}$ can be A;
$X^{149}$ can be W;
$X^{150}$ can be L;
$X^{151}$ can be selected from R, S, and T;
$X^{152}$ can be selected from G, K, N, R, and S;
$X^{153}$ can be selected from A, D, E, F, G, H, I, K, L, M, N, Q, R, S, T, V, W, and Y;
$X^{154}$ can be selected from E, G, and K;
$X^{155}$ can be selected from E, K, and S; and
$X^{156}$ can be selected from G, K, and R.

In IL-7Rα ligands of Formula (7)-(7e),
$X^{137}$ can be selected from I and V;
$X^{138}$ can be P;
$X^{139}$ can be W;
$X^{140}$ can be T;
$X^{141}$ can be L;
$X^{142}$ can be D;
$X^{143}$ can be P;
$X^{144}$ can be G;
$X^{145}$ can be S;
$X^{146}$ can be L;
$X^{147}$ can be Q;
$X^{148}$ can be A;
$X^{149}$ can be W; and
$X^{150}$ can be L.

An IL-7Rα ligand can comprise an amino acid sequence selected from any one of SEQ ID NOS: 190-349:

```
                                    SEQ ID NO: 190
A R H V P W C T L D P G S I Q C A W L R A N

SEQ ID NO: 191
A H Y I P W C T L D P G S L Q C A W L Q S H

SEQ ID NO: 192
D L S I P W C M L D P G S L Q C S Y I T K F

SEQ ID NO: 193
D R M V T G I P W C L L D P G S I Q C A W L

SEQ ID NO: 194
D M S I P W C N L D P G S L Q C A W I R A N

SEQ ID NO: 195
E N H W T R I P W C I L D P G S I Q C A W L

SEQ ID NO: 196
E R R I P W C H L D P G S L Q C A W L S R H

SEQ ID NO: 197
E K R F V E I P W C T L D P G S L Q C A Y L

SEQ ID NO: 198
E F R W S V I P W C T L D P G S V Q C A W L

SEQ ID NO: 199
E T R I P W C S L D P D S L Q C A Y L Q A H

SEQ ID NO: 200
E Y L G R I P W C T L D P G S L Q C A W L

SEQ ID NO: 201
F V S I P W C S L D P G S L Q C A W V T Y N

SEQ ID NO: 202
F T G V P W C L L D P G S L Q C T W L K I G
```

FVIPWCTLDPGGLQCAFIKGT  SEQ ID NO: 203

HLGVPWCTLDPGSIQCAWLAKH  SEQ ID NO: 204

HSWSEIPWCTLDPGSIQCAWI  SEQ ID NO: 205

HFLGLTIPWCSLDPGSLQCAWI  SEQ ID NO: 206

IRSCLWQPGALHCTWWAEEEPV  SEQ ID NO: 207

IPWCTLDPGSLQCAWLQKFGEG  SEQ ID NO: 208

IPWCILDPGSVQCAWLMQEKKE  SEQ ID NO: 209

IPWCTLDPGSVQCDYLLKSAKQ  SEQ ID NO: 210

IPWCTLDPGSLQCAWLTNTGAK  SEQ ID NO: 211

IPWCTLDPGSLQCAWLQGKEER  SEQ ID NO: 212

IGQVSRVPWCLLDPGSYQCGWL  SEQ ID NO: 213

IQVPWCMLAPGSLQCAYITRH  SEQ ID NO: 214

IPWCTLDPGSLQCAWL  SEQ ID NO: 215

IPWCLLDPGGLQCVWL  SEQ ID NO: 216

IPWCTLDPGSLQCAWLEERRSK  SEQ ID NO: 217

IPWCMLDPGSVQCLWLATQENG  SEQ ID NO: 218

IPWCSLDPGGLQCAWL  SEQ ID NO: 219

IPWCSLDPGSLQCAWM  SEQ ID NO: 220

IPWCTLDPGSLQCAWLSTQKVN  SEQ ID NO: 221

IPWCTLDPGSIQCAWM  SEQ ID NO: 222

IPWCMLDPGSIQCAWL  SEQ ID NO: 223

IPWCKLDPGSIQCVWL  SEQ ID NO: 224

IPWCKLDPGSLQCAYY  SEQ ID NO: 225

IPWCTLDPGSLQCAWV  SEQ ID NO: 226

IPWCTLDPGSLQCAWL  SEQ ID NO: 227

IPWCMLDPGSLQCAWM  SEQ ID NO: 228

IPWCTLDPGSFQCAWL  SEQ ID NO: 229

IPWCILDPGSVQCAFL  SEQ ID NO: 230

IPWCTLDPGSLQCAWLQKFGEG  SEQ ID NO: 231

IPWCALDPGSLQCAWLRSHGSE  SEQ ID NO: 232

IPWCTLDPGSLQCAYL  SEQ ID NO: 233

INWCLLDPGSLQCAWIRGDGHG  SEQ ID NO: 234

INWCLLDPGSLQCAWIRGDGHG  SEQ ID NO: 235

IPWCSLDPGSLQCAFY  SEQ ID NO: 236

IPWCTLDPGSIQCAFLQDMTSK  SEQ ID NO: 237

IPWCTLDPGSIQCAWLQRDPDL  SEQ ID NO: 238

IPWCTLDPGSIQCGWLKIQDKL  SEQ ID NO: 239

IPWCTLDPGSIQCVWVKEHLTR  SEQ ID NO: 240

IPWCLLDPGSLQCSYLKEAAEP  SEQ ID NO: 241

IPWCRLDPGSLQCLWQMRHAEN  SEQ ID NO: 242

IPWCTLDPGSLQCAFILGKTNS  SEQ ID NO: 243

IPWCALDPGSVQCAWLRRRGQR  SEQ ID NO: 244

IPWCLLDPGSVQCAYSKQGERA  SEQ ID NO: 245

IPWCTLDPGSVQCTWMKGQRAR  SEQ ID NO: 246

KAGSWFIPWCTLDPGSLQCAFL  SEQ ID NO: 247

KRRDSVIPWCLLDPGSLQCTWL  SEQ ID NO: 248

KRRIPWCSLDPGSLQCAYLERT  SEQ ID NO: 249

KTRIPWCTLDPGSIQCAWFMLY  SEQ ID NO: 250

LPWCTDHPGGQQCWWLEDREKR  SEQ ID NO: 251

LTSVPWCTLDPGSLQCAWLSRQ  SEQ ID NO: 252

MGGIPWCSLDPGSIQCAFLKKG  SEQ ID NO: 253

MQGGLGIPWCMLDPGSLQCLWL  SEQ ID NO: 254

METIPWCTLDPGSLQCHWITSS  SEQ ID NO: 255

MIHVPWCQLDPGGLQCAWLNDI  SEQ ID NO: 256

SEQ ID NO: 257
M C N S C F V P W C S L D P G S L Q C A W L R

SEQ ID NO: 258
N P F R S V V P W C A L D P G S L Q C A W L

SEQ ID NO: 259
N R M I P W C E L W P G S I Q C A W I T D L

SEQ ID NO: 260
N W S R S D V P W C T L D P G S I Q C A F L

SEQ ID NO: 261
N Q Q V P W C S L D P G G L Q C E W L K N R

SEQ ID NO: 262
Q M Q V P W C S L D P G S L Q C A W M N N Y

SEQ ID NO: 263
Q W V V P W C M L D P G S L Q C E W L K A N

SEQ ID NO: 264
Q A G W R G D F W C S L D P G S Q R C V R W

SEQ ID NO: 265
Q N K V P W C L L D P G S L Q C A W L R S N

SEQ ID NO: 266
Q T V V P W C T L D P G S L Q C A W L S R Q

SEQ ID NO: 267
Q T L V P W C S L D P G S L Q C T W L L K A

SEQ ID NO: 268
Q H R I P W C A L D P G G I Q C A Y L H R Q

SEQ ID NO: 269
R H F D D I P W C T L D P G S L Q C A Y L

SEQ ID NO: 270
R V Q M S F I P W C I L D P G S L Q C A W L

SEQ ID NO: 271
R D W T S G I P W C V L D P G S L Q C Q F L

SEQ ID NO: 272
R F S V T S V P W C L L D P G S L Q C E F L

SEQ ID NO: 273
R S A V P W C T L D P G S I Q C A Y L R N Q

SEQ ID NO: 274
R W I D T V I P W C S L D P G G L Q C L W L

SEQ ID NO: 275
R R E I P W C T L D P G G L Q C S W L R S I

SEQ ID NO: 276
R N P I P W C T L D P G G L Q C A W L E E H

SEQ ID NO: 277
R N A I P W C D L D P G S L Q C A Y L R K H

SEQ ID NO: 278
R P V V C A T L P G G Y V C R V T

SEQ ID NO: 279
S L T V P W C T L D P G S M Q C A W L Q N R

SEQ ID NO: 280
S G K W G D I P W C T L D P G S I Q C A W L

SEQ ID NO: 281
S E M G E S I P W C Q L D P G S V Q C A W L

SEQ ID NO: 282
S N I V P W C T L D P G G L Q C A W I M G R

SEQ ID NO: 283
S R R I P W C T L D P G S L Q C A W L R H Q

SEQ ID NO: 284
S T N H G Q I P W C T L D P G S L Q C T W L

SEQ ID NO: 285
S W S V P W C T L D P G S M Q C V W L Q M Q

SEQ ID NO: 286
T T E I Q D I P W C E L D P G S L Q C A Y M

SEQ ID NO: 287
T S R V P G C S L D P G S L Q C A W L R H F

SEQ ID NO: 288
V P W C M L D P G S M Q C A W L

SEQ ID NO: 289
V D W C I L D P G S L Q C S W L K N M W N K

SEQ ID NO: 290
V P W C E L D P G G L Q C S Y L R G W V T D

SEQ ID NO: 291
V L E T Q V P W C T L D P G S I Q C A W L

SEQ ID NO: 292
V P W C I L D P G S V Q C A W L R D N Q V W

SEQ ID NO: 293
V P W C T L D P G S Y Q C A W L

SEQ ID NO: 294
V G S T M R I P W C S L D P G S L Q C E Y L

SEQ ID NO: 295
V H R I P W C T L D P G G L Q C A W L R Q M

SEQ ID NO: 296
V P W C T L D P G S L Q C K W L

SEQ ID NO: 297
V P W C R L D P G S I Q C A Y L R
S E Q K S

SEQ ID NO: 298
V A G V P W C S L D P G S L Q C H W L N E H

SEQ ID NO: 299
V P W C T L D P G S I Q C A Y L K N Q V D G

SEQ ID NO: 300
V R Y V P W C T L D P G S I Q C A Y L Q E Q

SEQ ID NO: 301
V P W C N L D P G G L Q C E W L T R V L G R

SEQ ID NO: 302
V P W C M L D P G S L Q C S W L Q Q T F S N

SEQ ID NO: 303
V P W C T L D P G G I Q C A W L

SEQ ID NO: 304
V P W C T L D P G S I Q C H W L

SEQ ID NO: 305
V P W C T L D P G S F Q C A W L

SEQ ID NO: 306
V P W C L L D P G S V Q C A F L N R Q K E D

SEQ ID NO: 307
V P W C M L D P G S L Q C M Y L

SEQ ID NO: 308
V P W C M L D P G S I Q C A F L

SEQ ID NO: 309
V P W C T L D P G G L Q C A W M R G T Y S Q

VPWCRLDPGSVQCAWLRSRNNV (SEQ ID NO: 310)

VPWCALDPGSVQCAFL (SEQ ID NO: 311)

VPWCMLDPGSLQCMYL (SEQ ID NO: 312)

VPWCTLDPGSLQCAWF (SEQ ID NO: 313)

VPWCILDPGSLQCAYL (SEQ ID NO: 314)

VPWCHLDPGGIQCAYL (SEQ ID NO: 315)

VPWCSLDPGSLQCHWQVSRGWH (SEQ ID NO: 316)

VPWCELDPGSLQCAWLQTWGVN (SEQ ID NO: 317)

VPWCKIDPGSLQCAYLKRHQIL (SEQ ID NO: 318)

VPWCKLDPGSFQCAFLRELERQ (SEQ ID NO: 319)

VPWCLLDPGSLQCAWLKRMEVD (SEQ ID NO: 320)

VPWCLLDPGSLQCAWMRSGEGK (SEQ ID NO: 321)

VPWCLLDPGSLQCAYLEGKWDL (SEQ ID NO: 322)

VPWCMLDPGSIQCAWINEQNML (SEQ ID NO: 323)

VPWCMLDPGSLQCAWMRSQREE (SEQ ID NO: 324)

VPWCTIDPGSLQCTWLRVHRGE (SEQ ID NO: 325)

VPWCTLDPGSLQCAWLEKESRT (SEQ ID NO: 326)

VPWCTLDPGSLQCAWLISNARE (SEQ ID NO: 327)

VPWCTLDPGSLQCAWLKIQEAL (SEQ ID NO: 328)

VPWCTLDPGSLQCAWLKKHEGG (SEQ ID NO: 329)

VPWCTLDPGSLQCAWLNNHRSR (SEQ ID NO: 330)

VPWCTLDPGSLQCDWLMKRRNT (SEQ ID NO: 331)

VPWCTLDPGSLQCDYLKWMNMR (SEQ ID NO: 332)

VPWCTLDPGSLQCHWLLSRSDN (SEQ ID NO: 333)

VPWCTLDPGSVQCAYLKARRPS (SEQ ID NO: 334)

VPWCVLDPGSIQCEYLQRLHRQ (SEQ ID NO: 335)

WRRVPWCTLDPGSLQCAWLNSH (SEQ ID NO: 336)

WGIPWCTLDPGSLQCAWLGKH (SEQ ID NO: 337)

WTQIPWCTLDPGSIQCSWLSRE (SEQ ID NO: 338)

WVTIPWCILDPGSLQCEWQTKV (SEQ ID NO: 339)

WTQVPWCTLDPGSLQCDWLSKR (SEQ ID NO: 340)

WERDSEIPWCTLDPGSLQCAWL (SEQ ID NO: 341)

WFEIPWCTLDPGSLQCEWSMQN (SEQ ID NO: 342)

WRQTLQIPWCSLDPGSLQCAYL (SEQ ID NO: 343)

YSGRREIPWCTLDPGSLQCTWL (SEQ ID NO: 344)

YRSGHGIPWCMLDPGGLQCSWL (SEQ ID NO: 345)

YKGVSEIPWCVLDPGSVQCAYL (SEQ ID NO: 346)

YKYIPWCTLDPGSLQCAWLARN (SEQ ID NO: 347)

YQPVPWCTLDPGSLQCAWLSNI (SEQ ID NO: 348)

YNFVPWCMLDPGSLQCAYLRKT (SEQ ID NO: 349)

An IL-7Rα ligand can comprise an amino acid sequence selected from any one of SEQ ID NOS: 184-349, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 184-349, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 184-349.

An-IL-7Rα ligand can comprise a truncated amino acid sequence of any one of SEQ ID NOS: 184-349.

An IL-7Rα ligand of any one of SEQ ID NOS: 190-349 exhibited a direct binding to the hIL-7Rα subunit of less than 100 µM as determined by phage ELISA assays.

An IL-7Rα ligand can comprise an amino acid sequence of any one of SEQ ID NOS: 350-388, which are included in the Family 3A IL-7Rα ligands.

An IL-7Rα ligand can comprise the amino acid sequence of Formula (8) (SEQ ID NO: 350) or a partial amino acid sequence of Formula (8), such as the amino acid sequence of Formula (8a) (SEQ ID NO: 351), the amino acid sequence of Formula (8b) (SEQ ID NO: 352), the amino acid sequence of Formula (8c) (SEQ ID NO: 353), the amino acid sequence of Formula (8d) (SEQ ID NO: 354), or the amino acid sequence of Formula (8e) (SEQ ID NO: 355):

$$-X^{161}-X^{162}-X^{163}-X^{164}-X^{165}-X^{166}-C-X^{167}-X^{168}-X^{169}-X^{170}-X^{171}-X^{172}-X^{173}-X^{174}-C-X^{175}-X^{176}-X^{177}-X^{178}- \quad (8)$$
$$X^{179}-X^{180}-$$

$$-X^{164}-X^{165}-X^{166}-C-X^{167}-X^{168}-X^{169}-X^{170}-X^{171}-X^{172}-X^{173}-X^{174}-C-X^{175}-X^{176}-X^{177}- \quad (8a)$$

$$-X^{165}-X^{166}-C-X^{167}-X^{168}-X^{169}-X^{170}-X^{171}-X^{172}-X^{173}-X^{174}-C-X^{175}-X^{176}- \quad (8b)$$

$$-X^{166}-C-X^{167}-X^{168}-X^{169}-X^{170}-X^{171}-X^{172}-X^{173}-X^{174}-C-X^{175}- \quad (8c)$$

$$-C-X^{167}-X^{168}-X^{169}-X^{170}-X^{171}-X^{172}-X^{173}-X^{174}-C- \quad (8d)$$

$$-X^{167}-X^{168}-X^{169}-X^{170}-X^{171}-X^{172}-X^{173}-X^{174}- \quad (8e)$$

wherein,
$X^{161}$ can be selected from an amino acid;
$X^{162}$ can be selected from an amino acid;
$X^{163}$ can be selected from an amino acid;
$X^{164}$ can be selected from an amino acid comprising a basic side chain;
$X^{165}$ can be selected from an amino acid comprising a large hydrophobic side chain;
$X^{166}$ can be selected from an amino acid comprising an acidic side chain or an amino acid comprising a large hydrophobic side chain;
$X^{167}$ can be selected from an amino acid comprising a small hydrophobic side chain;
$X^{168}$ can be selected from an amino acid comprising an acidic side chain;
$X^{169}$ can be selected from an amino acid comprising a large hydrophobic side chain;
$X^{170}$ can be selected from an amino acid comprising a small hydrophobic side chain;
$X^{171}$ can be selected from an amino acid comprising a small hydrophobic side chain;
$X^{172}$ can be selected from an amino acid comprising a small hydrophobic side chain;
$X^{173}$ can be selected from an amino acid comprising a basic side chain or an amino acid comprising a large hydrophobic side chain;
$X^{174}$ can be selected from an amino acid comprising a polar/neutral side chain or a large hydrophobic side chain;
$X^{175}$ can be selected from an amino acid comprising a basic side chain;
$X^{176}$ can be selected from an amino acid comprising a large hydrophobic side chain;
$X^{177}$ can be selected from an amino acid comprising a basic side chain;
$X^{178}$ can be selected from an amino acid;
$X^{179}$ can be selected from an amino acid; and
$X^{180}$ can be selected from an amino acid.
In IL-7Rα ligands of Formula (8)-(8e), $X^{161}$ can be selected from G, K, L, R, and T.
In IL-7Rα ligands of Formula (8)-(8e), $X^{161}$ can be selected from G and R.
In IL-7Rα ligands of Formula (8)-(8e), $X^{161}$ can be G.
In IL-7Rα ligands of Formula (8)-(8e), $X^{162}$ can be selected from D, F, G, K, N, and R.
In IL-7Rα ligands of Formula (8)-(8e), $X^{162}$ can be selected from G, K, N, and R.
In IL-7Rα ligands of Formula (8)-(8e), $X^{163}$ can be selected from A, C, E, F, G, L, M, R, and V.
In IL-7Rα ligands of Formula (8)-(8e), $X^{163}$ can be G.
In IL-7Rα ligands of Formula (8)-(8e), $X^{164}$ can be selected from H, I, L, P, Q, and R.
In IL-7Rα ligands of Formula (8)-(8e), $X^{164}$ can be R.
In IL-7Rα ligands of Formula (8)-(8e), $X^{165}$ can be selected from I, L, Q, V, and Y.
In IL-7Rα ligands of Formula (8)-(8e), $X^{165}$ can be selected from I, L, and V.
In IL-7Rα ligands of Formula (8)-(8e), $X^{166}$ can be selected from D, E, and Y.
In IL-7Rα ligands of Formula (8)-(8e), $X^{166}$ can be selected from E and Y.
In IL-7Rα ligands of Formula (8)-(8e), $X^{167}$ can be selected from A, E, and Q.
In IL-7Rα ligands of Formula (8)-(8e), $X^{167}$ can be A.
In IL-7Rα ligands of Formula (8)-(8e), $X^{168}$ can be selected from D, E, K, N, Q, and S.
In IL-7Rα ligands of Formula (8)-(8e), $X^{168}$ can be selected from D and E.
In IL-7Rα ligands of Formula (8)-(8e), $X^{169}$ can be selected from F and L.
In IL-7Rα ligands of Formula (8)-(8e), $X^{169}$ can be L.
In IL-7Rα ligands of Formula (8)-(8e), $X^{170}$ can be P.
In IL-7Rα ligands of Formula (8)-(8e), $X^{171}$ can be G.
In IL-7Rα ligands of Formula (8)-(8e), $X^{172}$ can be G.
In IL-7Rα ligands of Formula (8)-(8e), $X^{173}$ can be selected from F, H, K, L, Q, and R.
In IL-7Rα ligands of Formula (8)-(8e), $X^{173}$ can be selected from F, L, and R.
In IL-7Rα ligands of Formula (8)-(8e), $X^{174}$ can be selected from A, H, I, N, Q, T, and V.
In IL-7Rα ligands of Formula (8)-(8e), $X^{174}$ can be selected from A, H, Q, and V.
In IL-7Rα ligands of Formula (8)-(8e), $X^{174}$ can be V.
In IL-7Rα ligands of Formula (8)-(8e), $X^{175}$ can be selected from E, K, and R.
In IL-7Rα ligands of Formula (8)-(8e), $X^{176}$ can be selected from A, C, F, G, L, M, S, and V.
In IL-7Rα ligands of Formula (8)-(8e), $X^{176}$ can be selected from L and S.
In IL-7Rα ligands of Formula (8)-(8e), $X^{176}$ can be L.
In IL-7Rα ligands of Formula (8)-(8e), $X^{177}$ can be selected from G, H, R, and W.
In IL-7Rα ligands of Formula (8)-(8e), $X^{177}$ can be R.
In IL-7Rα ligands of Formula (8)-(8e), $X^{178}$ can be selected from D, E, G, H, K, S, T, and V.

In IL-7Rα ligands of Formula (8)-(8e), $X^{178}$ can be selected from E and S.

In IL-7Rα ligands of Formula (8)-(8e), $X^{179}$ can be selected from A, D, E, M, Q, S, V, and W.

In IL-7Rα ligands of Formula (8)-(8e), $X^{179}$ can be selected from A and S.

In IL-7Rα ligands of Formula (8)-(8e), $X^{180}$ can be selected from D, E, G, I, L, M, R, and S.

In IL-7Rα ligands of Formula (8)-(8e), $X^{180}$ can be selected from D and E.

In IL-7Rα ligands of Formula (8)-(8e), the IL-7Rα ligand can be defined by any combination of variables as defined in the immediately preceding thirty-nine (39) paragraphs.

In IL-7Rα ligands of Formula (8)-(8e),
$X^{161}$ can be selected from G, K, L, R, and T;
$X^{162}$ can be selected from D, F, G, K, N, and R;
$X^{163}$ can be selected from A, C, E, F, G, L, M, R, and V;
$X^{164}$ can be selected from H, I, L, P, Q, and R;
$X^{165}$ can be selected from I, L, Q, V, and Y;
$X^{166}$ can be selected from D, E, and Y;
$X^{167}$ can be selected from A, E, and Q;
$X^{168}$ can be selected from D, E, K, N, Q, and S;
$X^{169}$ can be selected from F and L;
$X^{170}$ can be P;
$X^{171}$ can be G;
$X^{172}$ can be G;
$X^{173}$ can be selected from F, H, K, L, Q, and R;
$X^{174}$ can be selected from A, H, I, N, Q, T, and V;
$X^{175}$ can be selected from E, K, and R;
$X^{176}$ can be selected from A, C, F, G, L, M, S, and V;
$X^{177}$ can be selected from G, H, R, and W;
$X^{178}$ can be selected from D, E, G, H, K, S, T, and V;
$X^{179}$ can be selected from A, D, E, M, Q, S, V, and W; and
$X^{180}$ can be selected from D, E, G, I, L, M, R, and S.

In IL-7Rα ligands of Formula (8)-(8e),
$X^{161}$ can be selected from G and R;
$X^{162}$ can be selected from G, K, N, and R;
$X^{163}$ can be G;
$X^{164}$ can be selected from H, I, L, P, Q, and R;
$X^{165}$ can be selected from I, L, and V;
$X^{166}$ can be selected from E and Y;
$X^{167}$ can be A;
$X^{168}$ can be selected from D and E;
$X^{169}$ can be L;
$X^{170}$ can be P;
$X^{171}$ can be G;
$X^{172}$ can be G;
$X^{173}$ can be selected from F, L, and R;
$X^{174}$ can be selected from A, H, Q, and V;
$X^{175}$ can be selected from E, K, and R;
$X^{176}$ can be selected from L and S;
$X^{177}$ can be R;
$X^{178}$ can be selected from E and S;
$X^{179}$ can be selected from A and S; and
$X^{180}$ can be selected from D and E.

In IL-7Rα ligands of Formula (8)-(8e),
$X^{161}$ can be G;
$X^{162}$ can be selected from G, K, N, and R;
$X^{163}$ can be G;
$X^{164}$ can be R;
$X^{165}$ can be selected from I, L, and V;
$X^{166}$ can be selected from E and Y;
$X^{167}$ can be A;
$X^{168}$ can be selected from D and E;
$X^{169}$ can be L;
$X^{170}$ can be P;
$X^{171}$ can be G;
$X^{172}$ can be G;
$X^{173}$ can be selected from F, L, and R;
$X^{174}$ can be V;
$X^{175}$ can be selected from E, K, and R;
$X^{176}$ can be L;
$X^{177}$ can be R;
$X^{178}$ can be selected from E and S;
$X^{179}$ can be selected from A and S; and
$X^{180}$ can be selected from D and E.

In IL-7Rα ligands of Formula (8)-(8e),
$X^{164}$ can be R;
$X^{165}$ can be selected from I, L, and V;
$X^{166}$ can be selected from E and Y;
$X^{167}$ can be A;
$X^{168}$ can be selected from D and E;
$X^{169}$ can be L;
$X^{170}$ can be P;
$X^{171}$ can be G;
$X^{172}$ can be G;
$X^{173}$ can be selected from F, L, and R;
$X^{174}$ can be V;
$X^{175}$ can be selected from E, K, and R;
$X^{176}$ can be L; and
$X^{177}$ can be R.

An IL-7Rα ligand can comprise an amino acid sequence selected from any one of SEQ ID NOS: 356-388:

```
                                          SEQ ID NO: 356
F R L E C A D L P G G R N C R L R T S G

SEQ ID NO: 357
I L E C A E L P G G R H C R L R

SEQ ID NO: 358
K G V R L Y C A D L P G G R I C R S G K V E

SEQ ID NO: 359
L R L L Q Y C A D L P G G F N C R V R E D L

SEQ ID NO: 360
P V E C A E F P G G R V C R L R

SEQ ID NO: 361
Q I D C A D L P G G H V C R L R

SEQ ID NO: 362
R V E C A Q L P G G K V C R L R

SEQ ID NO: 363
R G C R L D C A D L P G G H T C R C R S A D

SEQ ID NO: 364
R I E C A D L P G G H V C R L R

SEQ ID NO: 365
R K M H L E C A D L P G G R H C R L R H E M

SEQ ID NO: 366
R N G R I E C A D L P G G F V C R M R D M D

SEQ ID NO: 367
R D V R L E C A D L P G G H V C R L R D S R

SEQ ID NO: 368
R K A R I D C A E L P G G R Q C R L H G W S

SEQ ID NO: 369
R V E C A Q L P G G K V C R M R

SEQ ID NO: 370
R V E C A E L P G G F V C R L R

SEQ ID NO: 371
R V Y C A D L P G G R Q C R S H
```

| | |
|---|---|
| SEQ ID NO: 372 | R I Y C A E L P G G Q V C R S R |
| SEQ ID NO: 373 | R R E P V Y C A D L P G G L H C R V R V S E |
| SEQ ID NO: 374 | R L E C A D L P G G R A C R L R |
| SEQ ID NO: 375 | R V Y C A D L P G G R Q C R S H |
| SEQ ID NO: 376 | R V Y C A E L P G G L A C R G R |
| SEQ ID NO: 377 | R N G R V Y C A D L P G G R Q C R S W G A I |
| SEQ ID NO: 378 | R L E C A N L P G G F N C R L R |
| SEQ ID NO: 379 | R L E C A D L P G G R H C R L R |
| SEQ ID NO: 380 | R L E C A K L P G G F N C R L R |
| SEQ ID NO: 381 | R I E C A E L P G G F T C R L R |
| SEQ ID NO: 382 | R I Y C E S L P G G F N C R L R |
| SEQ ID NO: 383 | R V Y C A E L P G G L A C R L R |
| SEQ ID NO: 384 | R Y E C A D L P G G L H C E F R |
| SEQ ID NO: 385 | R V E C A E L P G G F H C R L R |
| SEQ ID NO: 386 | R V E C A D L P G G R V C K S R |
| SEQ ID NO: 387 | R V E C A D L P G G L A C R L R |
| SEQ ID NO: 388 | T F R R V Y C Q E L P G G L V C R A H S Q D |

An IL-7Rα ligand can comprise an amino acid sequence selected from any one of SEQ ID NOS: 350-388, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 350-388, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An-IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 350-388.

An-IL-7Rα ligand can comprise a truncated amino acid sequence of any one of SEQ ID NOS: 350-388.

An IL-7Rα ligand of any one of SEQ ID NO: 356-388 bound to the hIL-7Rα subunit with an $IC_{50}$ of less than 100 μM.

An IL-7Rα ligand provided by the present disclosure can comprise the amino acid sequence of Formula (9) (SEQ ID NO: 389) or a partial amino acid sequence of Formula (9), such as an amino acid sequence of Formula (9a) (SEQ ID NO: 390), an amino acid sequence of Formula (9b) (SEQ ID NO: 391), or an amino acid sequence of Formula (9c) (SEQ ID NO: 392):

$$-X^{201}-X^{202}-X^{203}-X^{204}-X^{205}-X^{206}-X^{207}-X^{208}-X^{209}-X^{210}-X^{211}-X^{212}-X^{213}-X^{214}-X^{215}-X^{216}- \quad (9)$$

$$-X^{202}-X^{203}-X^{204}-X^{205}-X^{206}-X^{207}-X^{208}-X^{209}-X^{210}-X^{211}-X^{212}-X^{213}-X^{214}-X^{215}- \quad (9a)$$

$$-X^{203}-X^{204}-X^{205}-X^{206}-X^{207}-X^{208}-X^{209}-X^{210}-X^{211}-X^{212}-X^{213}-X^{214}- \quad (9b)$$

$$-X^{204}-X^{205}-X^{206}-X^{207}-X^{208}-X^{209}-X^{210}-X^{211}-X^{212}-X^{213}- \quad (9c)$$

wherein, $X^{201}$ can be selected from an amino acid comprising a large hydrophobic side chain;

$X^{202}$ can be selected from an amino acid comprising a small hydrophobic side chain or cysteine;

$X^{203}$ can be selected from an amino acid comprising a large hydrophobic side chain;

$X^{204}$ can be selected from an amino acid comprising a basic side chain or cysteine;

$X^{205}$ can be selected from an amino acid comprising a large hydrophobic side chain or an amino acid comprising small hydrophobic side chain;

$X^{206}$ can be selected from an amino acid comprising a large hydrophobic side chain or an amino acid comprising an acidic side chain;

$X^{207}$ can be selected from an amino acid comprising an acidic side chain;

$X^{208}$ can be selected from an amino acid comprising an acidic side chain or an amino acid comprising a small hydrophobic side chain;

$X^{209}$ can be selected from an amino acid comprising a small hydrophobic side chain;

$X^{210}$ can be selected from an amino acid comprising a large hydrophobic side chain or an amino acid comprising a small hydrophobic side chain;

$X^{211}$ can be selected from an amino acid comprising a large hydrophobic side chain;

$X^{212}$ can be selected from an amino acid comprising a polar/neutral side chain;

$X^{213}$ can be selected from cysteine;

$X^{214}$ can be selected from an amino acid comprising a small hydrophobic side chain or an amino acid comprising a large hydrophobic side chain;

$X^{215}$ can be selected from an amino acid comprising a large hydrophobic side chain; and $X^{216}$ can be selected from an amino acid comprising a large hydrophobic side chain.

In IL-7Rα ligands of Formula (9)-(9c), $X^{201}$ can be selected from H, I, Q, and V.

In IL-7Rα ligands of Formula (9)-(9c), $X^{201}$ can be selected from I, Q, and V.

In IL-7Rα ligands of Formula (9)-(9c), $X^{201}$ can be I.

In IL-7Rα ligands of Formula (9)-(9c), $X^{202}$ can be selected from C, P, and R.

In IL-7Rα ligands of Formula (9)-(9c), $X^{202}$ can be selected from C and P.

In IL-7Rα ligands of Formula (9)-(9c), $X^{203}$ can be selected from I, K, L, S, V, and W.

In IL-7Rα ligands of Formula (9)-(9c), $X^{203}$ can be W.

In IL-7Rα ligands of Formula (9)-(9c), $X^{204}$ can be selected from C and H.

In IL-7Rα ligands of Formula (9)-(9c), $X^{205}$ can be selected from A, I, L, M, T, and W.

In IL-7Rα ligands of Formula (9)-(9c), $X^{205}$ can be selected from T and W.

In IL-7Rα ligands of Formula (9)-(9c), $X^{206}$ can be selected from D, L, and W.

In IL-7Rα ligands of Formula (9)-(9c), $X^{206}$ can be selected from D and L.

In IL-7Rα ligands of Formula (9)-(9c), $X^{207}$ can be selected from D, I, L, and Q.

In IL-7Rα ligands of Formula (9)-(9c), $X^{207}$ can be selected from D and L.

In IL-7Rα ligands of Formula (9)-(9c), $X^{207}$ can be D.

In IL-7Rα ligands of Formula (9)-(9c), $X^{208}$ can be selected from D, E, and P.

In IL-7Rα ligands of Formula (9)-(9c), $X^{208}$ can be selected from E and P.

In IL-7Rα ligands of Formula (9)-(9c), $X^{208}$ can be P.

In IL-7Rα ligands of Formula (9)-(9c), $X^{209}$ can be selected from G, S, and T.

In IL-7Rα ligands of Formula (9)-(9c), $X^{209}$ can be selected from G and S.

In IL-7Rα ligands of Formula (9)-(9c), $X^{209}$ can be G.

In IL-7Rα ligands of Formula (9)-(9c), $X^{210}$ can be selected from A, G, L, and S.

In IL-7Rα ligands of Formula (9)-(9c), $X^{210}$ can be selected from L and S.

In IL-7Rα ligands of Formula (9)-(9c), $X^{211}$ can be selected from F, I, L, and M.

In IL-7Rα ligands of Formula (9)-(9c), $X^{211}$ can be L.

In IL-7Rα ligands of Formula (9)-(9c), $X^{212}$ can be selected from G, H, L, N, Q, and S.

In IL-7Rα ligands of Formula (9)-(9c), $X^{212}$ can be selected from Q and S.

In IL-7Rα ligands of Formula (9)-(9c), $X^{212}$ can be Q.

In IL-7Rα ligands of Formula (9)-(9c), $X^{213}$ can be C.

In IL-7Rα ligands of Formula (9)-(9c), $X^{214}$ can be selected from A, E, I, L, S, T, and V.

In IL-7Rα ligands of Formula (9)-(9c), $X^{214}$ can be selected from A and V.

In IL-7Rα ligands of Formula (9)-(9c), $X^{215}$ can be selected from F, R, W, and Y.

In IL-7Rα ligands of Formula (9)-(9c), $X^{215}$ can be W.

In IL-7Rα ligands of Formula (9)-(9c), $X^{216}$ can be selected from E, L, Q, and W.

In IL-7Rα ligands of Formula (9)-(9c), $X^{216}$ can be L.

In IL-7Rα ligands of Formula (9)-(9c), the IL-7Rα ligand can be defined by any combination of variables as defined in the immediately preceding thirty-five (35) paragraphs.

In IL-7Rα ligands of Formula (9)-(9c), $X^{201}$ can be selected from H, I, Q, and V;

$X^{202}$ can be selected from C, P, and R;

$X^{203}$ can be selected from I, K, L, S, V, and W;

$X^{204}$ can be selected from C and H;

$X^{205}$ can be selected from A, I, L, M, T, and W;

$X^{206}$ can be selected from D, L, and W;

$X^{207}$ can be selected from D, I, L, and Q;

$X^{208}$ can be selected from D, E, and P;

$X^{209}$ can be selected from G, S, and T;

$X^{210}$ can be selected from A, G, L, and S;

$X^{211}$ can be selected from F, I, L, and M;

$X^{212}$ can be selected from G, H, L, N, Q, and S;

$X^{213}$ can be C;

$X^{214}$ can be selected from A, E, I, L, S, T, and V;

$X^{215}$ can be selected from F, R, W, and Y; and $X^{216}$ can be selected from E, L, Q, and W.

In IL-7Rα ligands of Formula (9)-(9c), $X^{201}$ can be selected from I, Q, and V;

$X^{202}$ can be selected from C and P;

$X^{203}$ can be W;

$X^{204}$ can be selected from C and H;

$X^{205}$ can be selected from T and W;

$X^{206}$ can be selected from D and L;

$X^{207}$ can be selected from D and L;

$X^{208}$ can be selected from E and P;

$X^{209}$ can be selected from G and S;

$X^{210}$ can be selected from L and S;

$X^{211}$ can be L;

$X^{212}$ can be selected from Q and S;

$X^{213}$ can be C;

$X^{214}$ can be selected from A and V; and $X^{215}$ can be W; and $X^{216}$ can be L.

In IL-7Rα ligands of Formula (9)-(9c), $X^{201}$ can be I;

$X^{202}$ can be selected from C and P;

$X^{203}$ can be W;

$X^{204}$ can be selected from C and H;

$X^{205}$ can be selected from T and W;

$X^{206}$ can be selected from D and L;

$X^{207}$ can be D;

$X^{208}$ can be P;

$X^{209}$ can be G;

$X^{210}$ can be selected from L and S;

$X^{211}$ can be L;

$X^{212}$ can be Q;

$X^{213}$ can be C;

$X^{214}$ can be selected from A and V;

$X^{215}$ can be W; and $X^{216}$ can be L.

In IL-7Rα ligands of Formula (9)-(9c), $X^{201}$ can be Q;

$X^{202}$ can be C;

$X^{203}$ can be selected from I, L, K, and V;

$X^{204}$ can be H;

$X^{205}$ can be W;

$X^{206}$ can be D;

$X^{207}$ can be selected from I and L;

$X^{208}$ can be E;

$X^{209}$ can be selected from S and T;

$X^{210}$ can be L;
$X^{211}$ can be L;
$X^{212}$ can be selected from G, L, N, and S;
$X^{213}$ can be C;
$X^{214}$ can be selected from I, L, and V;
$X^{215}$ can be R; and
$X^{216}$ can be E.

In IL-7Rα ligands of Formula (9)-(9c),
$X^{201}$ can be selected from I and V;
$X^{202}$ can be P;
$X^{203}$ can be W;
$X^{204}$ can be C;
$X^{205}$ can be T;
$X^{206}$ can be L;
$X^{207}$ can be D;
$X^{208}$ can be P;
$X^{209}$ can be G;
$X^{210}$ can be selected from L and S;
$X^{211}$ can be L;
$X^{212}$ can be Q;
$X^{213}$ can be C;
$X^{214}$ can be A;
$X^{215}$ can be selected from W; and
$X^{216}$ can be L.

An IL-7Rα ligand can comprise an amino acid sequence selected from any one of SEQ ID NOS: 393-410:

```
                                        SEQ ID NO: 393
H C L H W N I E T L M S C V Y G N F E E

SEQ ID NO: 394
H C K H W D L E S L L L C V

SEQ ID NO: 395
H L G V P W C T L D P G S I Q C A W L A K H

SEQ ID NO: 396
I R S C L W Q P G A L H C T W W A E E E P V

SEQ ID NO: 397
I P W C L L D P G G L Q C V W L

SEQ ID NO: 398
K A G S W F I P W C T L D P G S L Q C A F L

SEQ ID NO: 399
N P F R S V V P W C A L D P G S L Q C A W L

SEQ ID NO: 400
Q C I H W D I E T L L S C V

SEQ ID NO: 401
Q C I H W D L E S L L N C L R E L K E P

SEQ ID NO: 402
Q C V H W D L D T L F G C I R E Q L E L

SEQ ID NO: 403
R H F D D I I P W C T L D P G S L Q C A Y L

SEQ ID NO: 404
S A K V L K Q C L H W D L E S L L S C L

SEQ ID NO: 405
S L T V P W C T L D P G S M Q C A W L Q N R

SEQ ID NO: 406
V P W C M L D P G S M Q C A W L

SEQ ID NO: 407
V H R I P W C T L D P G G L Q C A W L R Q M

SEQ ID NO: 408
W V T I P W C I L D P G S L Q C E W Q T K V

SEQ ID NO: 409
G W G I P W C T L D P G S L Q C A W L G K H

SEQ ID NO: 410
Y R S G H G I P W C M L D P G G L Q C S W L
```

An IL-7Rα ligand can comprise an amino acid sequence selected from any one of SEQ ID NOS: 389-410, wherein the amino acid sequence can be terminated with one or more amino acids such as one or more glycines (-G-) on the N-terminus, on the C-terminus, or on both the N- and C-termini.

An IL-7Rα ligand can comprise an amino acid sequence selected from any one of SEQ ID NOS: 389-410, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An IL-7Rα ligand can comprise an amino acid sequence similarity greater than 60%, greater than 70%, greater than 75%, greater than 80%, greater than 85%, greater than 90%, or greater than 95% to the amino acid sequence of any one of SEQ ID NOS: 389-410.

An-IL-7Rα ligand can comprise a truncated amino acid sequence of any one of SEQ ID NOS: 389-410.

An IL-7Rα ligand of any one of SEQ ID NOS: 393-410 bound to the hIL-7Rα subunit with an $IC_{50}$ of less than 10 μM as determined using phage ELISA competition assays.

An IL-7Rα ligand can comprise an amino acid sequence selected from any one of SEQ ID NOS: 520-596:

```
                                        SEQ ID NO: 520
I P W C T L D P G G L Q C A W L R Q M

SEQ ID NO: 521
I P W C T L D P G G L Q C A A L R Q M

SEQ ID NO: 522
I P W C T L D P G G L Q C A F L R Q M

SEQ ID NO: 523
I P W C T L D P G G L Q C A Y L R Q M

SEQ ID NO: 524
I P W C T L D P G G L Q C A H L R Q M

SEQ ID NO: 525
I P W C T L D P G G L Q C A W A R Q M

SEQ ID NO: 526
I P W C T L D P G G L Q C A W I R Q M

SEQ ID NO: 527
I P W C T L D P G G L Q C A W V R Q M
```

```
                        SEQ ID NO: 528
I P W C T L D P G G L Q C A W L A Q M

SEQ ID NO: 529
I P W C T L D P G G L Q C A W L K Q M

SEQ ID NO: 530
I P W C T L D P G G L Q C A W L H Q M

SEQ ID NO: 531
I P W C T L D P G G L Q C A W L R A M

SEQ ID NO: 532
I P W C T L D P G G L Q C A W L R Q A

SEQ ID NO: 533
I P W C T L D P G G L Q C A W L R A A

SEQ ID NO: 534
I P W C T L D P G G L Q C A W L A A A

SEQ ID NO: 520
I P W C T L D P G G L Q C A W L R Q M

SEQ ID NO: 535
I P W C T L D P G G L Q C A W L R Q

SEQ ID NO: 536
I P W C T L D P G G L Q C A W L R

SEQ ID NO: 537
I P W C T L D P G G L Q C A W L

SEQ ID NO: 538
I P W C T L D P G G L Q C A W

SEQ ID NO: 539
I P W C T L D P G G L Q C A W L R Q M G G

SEQ ID NO: 540
I P W C T L D P G G L Q C A W L R Q G G

SEQ ID NO: 541
I P W C T L D P G G L Q C A W L R G G

SEQ ID NO: 542
I P W C T L D P G G L Q C A W L G G

SEQ ID NO: 543
I P W C T L D P G G L Q C A W G G

SEQ ID NO: 544
G G I P W C T L D P G G L Q C A W L R Q M

SEQ ID NO: 545
G G I P W C T L D P G G L Q C A W L R Q

SEQ ID NO: 546
G G I P W C T L D P G G L Q C A W L R

SEQ ID NO: 547
G G I P W C T L D P G G L Q C A W L

SEQ ID NO: 548
G G I P W C T L D P G G L Q C A W

SEQ ID NO: 549
G G I P W C T L D P G G L Q C A W L R Q M G G

SEQ ID NO: 550
G G I P W C T L D P G G L Q C A W L R Q G G

SEQ ID NO: 551
G G I P W C T L D P G G L Q C A W L R G G

SEQ ID NO: 552
G G I P W C T L D P G G L Q C A W L G G

SEQ ID NO: 553
G G I P W C T L D P G G L Q C A W G G

SEQ ID NO: 407
V H R I P W C T L D P G G L Q C A W L R Q M

SEQ ID NO: 554
V H R I P W C T L D P G G L Q C A W L R Q M G G

SEQ ID NO: 555
G G V H R I P W C T L D P G G L Q C A W L R Q M

SEQ ID NO: 556
G G V H R I P W C T L D P G G L Q C A W L R Q M G G

SEQ ID NO: 557
V H R I P W C T L D P G G L Q C A W L R Q

SEQ ID NO: 558
V H R I P W C T L D P G G L Q C A W L R

SEQ ID NO: 559
V H R I P W C T L D P G G L Q C A W L R M

SEQ ID NO: 560
G G V H R I P W C T L D P G G L Q C A W L R Q

SEQ ID NO: 561
G G V H R I P W C T L D P G G L Q C A W L R

SEQ ID NO: 562
G G V H R I P W C T L D P G G L Q C A W L R M

SEQ ID NO: 563
V H R I P W C T L D P G G L Q C A W A R Q M

SEQ ID NO: 564
V H R I P W C T L D P G G L Q C A W A R Q M G G

SEQ ID NO: 565
G G V H R I P W C T L D P G G L Q C A W A R Q M

SEQ ID NO: 566
G G V H R I P W C T L D P G G L Q C A W A R Q M G G

SEQ ID NO: 567
V H R I P W C T L D P G G L Q C A W V R Q M

SEQ ID NO: 568
V H R I P W C T L D P G G L Q C A W V R Q M G G

SEQ ID NO: 569
G G V H R I P W C T L D P G G L Q C A W V R Q M

SEQ ID NO: 570
G G V H R I P W C T L D P G G L Q C A W V R Q M G G

SEQ ID NO: 571
V H R I P W C T L D P G G L Q C A W I R Q M

SEQ ID NO: 572
V H R I P W C T L D P G G L Q C A W I R Q M G G

SEQ ID NO: 573
G G V H R I P W C T L D P G G L Q C A W I R Q M

SEQ ID NO: 574
G G V H R I P W C T L D P G G L Q C A W I R Q M G G

SEQ ID NO: 575
I E G R G G Q C I H W D I E T L L S C V

SEQ ID NO: 576
I E G R G G V P W C T L D P G S L Q C A W F

SEQ ID NO: 577
I E G R G G R Y E C A D L P G G L H C E F R

SEQ ID NO: 578
R S C L W Q P G A L H C T W W A E E E P V

SEQ ID NO: 579
G G I E G R G G Q C I H W D I E T L L S C V
```

```
GGIEGRGGVPWCTLDPGSLQCAWF                     SEQ ID NO: 580

GGIEGRGGRYECADLPGGLHCEFR                     SEQ ID NO: 581

GGRSCLWQPGALHCTWWAEEEPV                      SEQ ID NO: 582

QCVHWDLDTLFGCIREQLEGG                        SEQ ID NO: 583

QCVHWDLDTLFGCIREQLELGG                       SEQ ID NO: 584

GGQCVHWDLDTLFGCIREQLEL                       SEQ ID NO: 585

GGQCVHWDLDTLFGCIREQLELGG                     SEQ ID NO: 586

GGHLGVPWCTLDPGSIQCAWLAKHGG                   SEQ ID NO: 587
```

Examples of truncated IL-7Rα ligands based on SEQ ID NOS: 407 and 454 include:

```
VHRIPWCTLDPGGLQCAWLRQM                       SEQ ID NO: 407

VHRIPWCTLDPGGLQCAWLRQMGG                     SEQ ID NO: 554

VHRIPWCTLDPGGLQCAWLRQ                        SEQ ID NO: 557

VHRIPWCTLDPGGLQCAWLR                         SEQ ID NO: 558

VHRIPWCTLDPGGLQCAWL                          SEQ ID NO: 514

VHRIPWCTLDPGGLQCAW                           SEQ ID NO: 588

VHRIPWCTLDPGGLQCA                            SEQ ID NO: 589

VHRIPWCTLDPGGLQC                             SEQ ID NO: 590

VHRIPW

In an IL-7Rα ligand of any one of Formula (10)-(10g), $X^{217}$ can be G, $X^{218}$ can be K, and $X^{219}$ can be H.

In an IL-7Rα ligand of Formula (10)-(10g), the IL-7Rα ligand can be defined by any combination of variables as defined in the immediately preceding nine (9) paragraphs.

An IL-7Rα ligand such as an IL-7Rα ligand of any one of Formula (10)-(10g) can comprise an amino acid sequence or a truncated amino acid sequence selected from any one of SEQ ID NOS: 535-537 and 605-655:

```
                                        SEQ ID NO: 537
I P W C T L D P G G L Q C A W L

SEQ ID NO: 536
I P W C T L D P G G L Q C A W L R

SEQ ID NO: 535
I P W C T L D P G G L Q C A W L R Q

SEQ ID NO: 605
I P W C T L D P G G L Q C A W L R G

SEQ ID NO: 606
I P W C T L D P G G L Q C A W L R Q G

SEQ ID NO: 607
I P W C T L D P G G L Q C A W L R G G

SEQ ID NO: 608
I P W C T L D P G G L Q C A W L G

SEQ ID NO: 609
I P W C T L D P G G L Q C A W L G K

SEQ ID NO: 610
I P W C T L D P G G L Q C A W L G K H

SEQ ID NO: 611
V H R I P W C T L D P G G L Q C A W L

SEQ ID NO: 612
V H R I P W C T L D P G G L Q C A W L R

SEQ ID NO: 613
V H R I P W C T L D P G G L Q C A W L R Q

SEQ ID NO: 614
V H R I P W C T L D P G G L Q C A W L R G

SEQ ID NO: 615
V H R I P W C T L D P G G L Q C A W L R Q G

SEQ ID NO: 616
V H R I P W C T L D P G G L Q C A W L R G G

SEQ ID NO: 617
V H R I P W C T L D P G G L Q C A W L G

SEQ ID NO: 618
V H R I P W C T L D P G G L Q C A W L G K

SEQ ID NO: 619
V H R I P W C T L D P G G L Q C A W L G K H

SEQ ID NO: 620
G W G I P W C T L D P G G L Q C A W L

SEQ ID NO: 621
G W G I P W C T L D P G G L Q C A W L R

SEQ ID NO: 622
G W G I P W C T L D P G G L Q C A W L R Q

SEQ ID NO: 623
G W G I P W C T L D P G G L Q C A W L R G

SEQ ID NO: 624
G W G I P W C T L D P G G L Q C A W L R Q G
```

-continued
```
                                        SEQ ID NO: 625
G W G I P W C T L D P G G L Q C A W L R G G

SEQ ID NO: 626
G W G I P W C T L D P G G L Q C A W L G

SEQ ID NO: 627
G W G I P W C T L D P G G L Q C A W L G K

SEQ ID NO: 628
G W G I P W C T L D P G G L Q C A W L G K H

SEQ ID NO: 629
I P W C T L D P G S L Q C A W L

SEQ ID NO: 630
I P W C T L D P G S L Q C A W L R

SEQ ID NO: 631
I P W C T L D P G S L Q C A W L R Q

SEQ ID NO: 632
I P W C T L D P G S L Q C A W L R G

SEQ ID NO: 633
I P W C T L D P G S L Q C A W L R Q G

SEQ ID NO: 634
I P W C T L D P G S L Q C A W L R G G

SEQ ID NO: 635
I P W C T L D P G S L Q C A W L G

SEQ ID NO: 636
I P W C T L D P G S L Q C A W L G K

SEQ ID NO: 637
I P W C T L D P G S L Q C A W L G K H

SEQ ID NO: 638
V H R I P W C T L D P G S L Q C A W L

SEQ ID NO: 639
V H R I P W C T L D P G S L Q C A W L R

SEQ ID NO: 640
V H R I P W C T L D P G S L Q C A W L R Q

SEQ ID NO: 641
V H R I P W C T L D P G S L Q C A W L R G

SEQ ID NO: 642
V H R I P W C T L D P G S L Q C A W L R Q G

SEQ ID NO: 643
V H R I P W C T L D P G S L Q C A W L R G G

SEQ ID NO: 644
V H R I P W C T L D P G S L Q C A W L G

SEQ ID NO: 645
V H R I P W C T L D P G S L Q C A W L G K

SEQ ID NO: 646
V H R I P W C T L D P G S L Q C A W L G K H

SEQ ID NO: 647
G W G I P W C T L D P G S L Q C A W L

SEQ ID NO: 648
G W G I P W C T L D P G S L Q C A W L R

SEQ ID NO: 649
G W G I P W C T L D P G S L Q C A W L R Q

SEQ ID NO: 650
G W G I P W C T L D P G S L Q C A W L R G

SEQ ID NO: 651
G W G I P W C T L D P G S L Q C A W L R Q G
```

-continued

SEQ ID NO: 652
G W G I P W C T L D P G S L Q C A W L R G G

SEQ ID NO: 653
G W G I P W C T L D P G S L Q C A W L G

SEQ ID NO: 654
G W G I P W C T L D P G S L Q C A W L G K

SEQ ID NO: 655
G W G I P W C T L D P G S L Q C A W L G K H

An IL-7Rα ligand such as an IL-7Rα ligand of any one of Formula (10)-(10g) can comprise an amino acid sequence or a truncated amino acid sequence selected from any one of SEQ ID NOS: 407, 514, 554-558, and 589-596:

An IL-7Rα ligand provided by the present disclosure can comprise a truncated amino acid sequence of any one of SEQ ID NOS: 520-655.

An IL-7Rα ligand provided by the present disclosure can comprise an amino acid sequence selected from any one of SEQ ID NOS: 520-655, or a truncated amino acid sequence of any one of SEQ ID NOS: 520-655, wherein the amino acid sequence can independently comprise from 1 to 4 glycines (G) on the N-terminus, on the C-terminus, or on both the N- and C-termini.

An IL-7Rα ligand provided by the present disclosure can comprise an amino acid sequence selected from any one of SEQ ID NOS: 520-655, or a truncated amino acid sequence of any one of SEQ ID NOS: 520-655, wherein the amino acid sequence comprises one or more amino acid substitutions such as from 1 to 5 amino acid substitutions. The amino acid substitutes can comprise conservative amino acid substitutions.

An IL-7Rα ligand can comprise an amino acid sequence or a truncated amino acid sequence similarity greater than 60%, greater than 70%, greater than 75%, greater than 80%, greater than 85%, greater than 90%, or greater than 95% to the amino acid sequence of any one of SEQ ID NOS: 520-655.

An IL-7Rα ligand of any one of SEQ ID NOS: 520-655 bind to the hIL-7Rα subunit with an $IC_{50}$ of less than 10 μM as determined using phage ELISA competition assays.

Certain IL-7Rα ligands provided by the present disclosure can bind to a unique binding site on the IL-7Rα subunit that is different from the binding site on the IL-7Rα subunit to which IL-7 binds. IL-7Rα ligands having SEQ ID NOS: 5, 43, 104, 146, and 458 do not bind competitively with IL-7 binding to IL-7Rα, indicating that the IL-7Rα ligand binding site for these compounds is distinct from that of IL-7. This group of IL-7Rα ligands bind to a unique binding site on the IL-7Rα subunit with an $IC_{50}$ of less than 10 μM.

IL-7Rα binding compound provided by the present disclosure can comprise one or more IL-7Rα ligands provided by the present disclosure.

An IL-7Rα binding compound can comprise an IL-7Rα ligand having an amino acid sequence of any one of SEQ ID NOS: 1-410 and 520-655 or Formula (1)-(10g).

An IL-7Rα binding compound can comprise, for example, an IL-7Rα, a homomeric IL-7Rα binding compound, a heteromeric IL-7Rα binding compound, or an IL-7Rα ligand construct.

A homomeric IL-7Rα binding compound can comprise two or more IL-7Rα ligands provided by the present disclosure.

A heteromeric IL-7Rα binding compound can comprise an IL-7Rα ligand and another ligand such as, for example, an Rγc ligand.

IL-7Rα constructs provided by the present disclosure can comprise at least one IL-7Rα ligand coupled to another molecule referred to as a construct partner such as a polymer, protein, Fc-fragment, immunoglobulin fragment, or antibody.

IL-7Rα constructs provided by the present disclosure can comprise at least one IL-7Rα ligand and at least one Rγc coupled to another molecule referred to as a construct partner such as a polymer, protein, Fc-fragment, immunoglobulin fragment, or antibody.

Certain IL-7Rα ligands provided by the present disclosure can bind to a unique binding site on the IL-7Rα subunit that is different than the binding site on the IL-7Rα subunit to which IL-7 binds.

IL-7Rα ligands having SEQ ID NOS: 5, 43, 104, 146, and 458 do not bind competitively with IL-7 binding to IL-7Rα, indicating that the IL-7Rα ligand binding site is distinct from that of IL-7.

The group of IL-7Rα ligand bind to the unique binding site on the IL-7Rα subunit with an $IC_{50}$ of less than 10 μM.

The unique binding site on the IL-7Rα subunit can be characterized by at least the following properties: (1) a group of IL-7Rα ligands bind to the unique binding site on the IL-7Rα subunit with an $IC_{50}$ of less than 10 μM; (2) each of the IL-7Rα ligands within the group competitively bind to the unique binding site on the IL-7Rα subunit with each of other IL-7Rα ligands within the group; and (3) a peptide having the amino acid sequence of SEQ ID. NO: 429 does not compete for binding to the unique binding site on the IL-7Rα subunit with the peptides within the group of IL-7Rα ligands; and (4) IL-7Rα ligands having SEQ ID NOS: 5, 43, 104, 146, and 458 do not bind competitively with IL-7 binding to IL-7Rα, indicating that the IL-7Rα ligand binding site is distinct from that of IL-7.

The group of IL-7Rα ligands comprises at least the IL-7Rα ligands having the amino acid sequence of any one of SEQ ID NOS: 5, 43, 104, 146, and 458.

The unique binding site of the IL-7Rα subunit for these IL-7Rα ligands can be characterized using competitive binding assays as described, for example, in Example 11.

An IL-7Rα ligand may not comprise any flanking amino acids bound to the N-terminus and/or to the C-terminus of the IL-7Rα ligand.

An IL-7Rα ligand can comprise one or more flanking amino acids bound to the N-terminus and/or to the C-terminus of the ligand.

The flanking amino acids can separate the portion of the ligand that interacts with IL-7R from other portions of the ligand and/or ligand construct.

An IL-7Rα ligand can comprise, for example, from 1 to 20 amino acids, from 1 to 10 amino acids, such as from 1 to 8 amino acids, from 2 to 6 amino acids, or from 2 to 4 amino acids bound to the N-terminus and/or the C-terminus of the IL-7Rα ligand.

Flanking amino acids can comprise any suitable naturally occurring or non-naturally occurring amino acids.

Flanking amino acids can be selected from flexible amino acids such as glycine and serine.

An IL-7Rα ligand can comprise, for example, terminal glycine groups on the N-terminus and/or the C-terminus of the respective ligand. For example, an IL-7Rα ligand can comprise (-G-)$_n$ glycine groups where n is from 1 to 10 (SEQ ID NO: 436), from 1 to 8, from 2 to 6, from 2 to 4, or from 2 to 3. For example, an IL-7Rα ligand can independently comprise 1, 2 or 3 terminal glycine groups. For example, a ligand having the amino acid sequence W-H-P-C-W-I-A-Q-L-G-E-L-C-D-L-E- (SEQ ID NO: 432) can independently include flanking glycines such as -G-, -G-G- (SEQ ID NO: 9399), or -G-G-G- (SEQ ID NO: 9400) on both the N-terminus and the C-terminus such that the ligand can have the amino acid sequence G-W-H-P-C-W-I-A-Q-L-G-E-L-C-D-L-E-G- (SEQ ID NO: 433), -G-G-W-H-P-C-W-I-A-Q-L-G-E-L-C-D-L-E-G-G- (SEQ ID NO: 434), or -G-G-G-W-H-P-C-W-I-A-Q-L-G-E-L-C-D-L-E-G-G-G- (SEQ ID NO: 435), respectively.

An IL-7Rα binding compound such as a dimeric IL-7Rα binding compound can comprise, for example, a first IL-7Rα ligand and a second IL-7Rα ligand bound to a ligand linker, or an IL-7Rα ligand and an Rγc ligand bound to a ligand linker.

Each of an IL-7Rα ligand and an Rγc ligand can independently be covalently bound to a ligand linker through the N-terminus or the C-terminus of the respective ligand. For example, an IL-7Rα ligand can be bound to the ligand linker through the N-terminus and an Rγc ligand can be bound to the ligand linker through the N-terminus; an IL-7Rα ligand can be bound to a ligand linker through the N-terminus and an Rγc ligand can be bound to the ligand linker through the C-terminus; an IL-7Rα ligand can be bound to the ligand linker through the C-terminus and an Rγc ligand can be bound to the ligand linker through the N-terminus; or an IL-7Rα ligand can be bound to the ligand linker through the C-terminus and an Rγc ligand can be bound to the linker through the C-terminus.

Examples of heterodimeric IL-7Rα ligands having various orientations of an IL-7Rα ligand and an Rγc ligand are shown in FIG. 1. As shown in FIG. 1, IL-7Rα ligands and Rγc ligands bond to a synthetic ligand linker and having various C/N orientations of the IL-7Rα ligand and the Rγc ligand can be synthesized using click chemistry. The triazole linkage is a schematic representation of a ligand linker, which can comprise various chemical moieties and can have a various lengths and properties. Examples of certain synthetic ligand linkers are shown in Table 1. The ligands shown in FIG. 1 have the following amino acid sequences:

```
                                            SEQ ID NO: 462
G G H L G V P W C T L D P G S I Q C A W L A K H G

SEQ ID NO: 463
G G H L G V P W C T L D P G S I Q C A W L A K H G G

SEQ ID NO: 465
G G V V C Q D W E G V E L C W Q G G

SEQ ID NO: 554
V H R I P W C T L D P G G L Q C A W L R Q M G G
```

A ligand linker can be configured to facilitate binding of an IL-7Rα ligand to the IL-7Rα subunit of IL-7R. For example, a ligand linker can be configured to facilitate activation of IL-7R. For example, the ligand linker can be configured to induce IL-7R-mediated STAT5 phosphorylation in TF-1-7Rα and NK-92 cells.

A ligand linker can have a length, for example, from 2 Å to 100 Å, from 2 Å to 80 Å, from 2 Å to 60 Å, from 2 Å to 40 Å, from 2 Å to 20 Å, from 4 Å to 18 Å, from 6 Å to 16 Å, or from 8 Å to 14 Å. A ligand linker can have a length, for example, less than 100 Å, less than 80 Å, less than 60 Å, less than 40 Å, less than 20 Å, less than 15 Å, or less than 10 Å.

A ligand linker can comprise a backbone having, for example, from 2 to 50 bonds, from 2 to 45 bonds, from 2 to 40 bonds, from 2 to 35 bonds, from 2 to 30 bonds, from 2 to 25 bonds, from 2 to 20 bonds, from 4 to 18 bonds, from 6 to 16 bonds, or from 8 to 14 bonds. A ligand linker can comprise a backbone having, for example, less than 50 bonds, less than 40 bonds, less than 30 bonds, less than 20 bonds, or less than 10 bonds.

A ligand linker provided by the present disclosure can comprise a peptidyl ligand linker or a synthetic ligand linker.

A ligand linker provided by the present disclosure can comprise a peptidyl ligand linker.

A peptidyl ligand linker can comprise, for example, from 2 to 100 amino acids, from 2 to 80 amino acids, from 2 to 60 amino acids, from 2 to 40 amino acids, from 2 to 20 amino acids, from 5 to 10 amino acids, or from 2 to 5 amino acids. A peptidyl ligand linker can comprise, for example, less than 100 amino acids, less than 80 amino acids, less than 40 amino acids, less than 20 amino acids, less than 15 amino acids, less than 10 amino acids, or less than 5 amino acids. Amino acids forming a ligand linker can comprise naturally occurring amino acids and/or non-naturally occurring amino acids.

A peptidyl ligand linker can comprise, for example, flexible amino acids such as glycine, serine, and/or threonine. Flexible linkers can include small, non-polar amino acids such as glycine or polar amino acids such as serine or threonine. The small size of these amino acids provides flexibility and allows for mobility of the connecting functional domains. Incorporation of serine or threonine can maintain the stability of the linker in aqueous solutions by forming hydrogen bonds with water molecules, and thereby reduces unfavorable interactions between the linker and protein moieties. Amino acids such as lysine and glutamic acid can be included to improve solubility. The length of a peptidyl linker can be selected to provide a suitable separation between two IL-7Rα ligands or an IL-7Rα ligand and an Rγc ligand to favor a desired interaction with IL-7R such as enhancing agonist activity. Examples of flexible linkers include $(G)_n$ (SEQ ID NO: 9385), $(GS)_n$ (SEQ ID NO: 9386), $(GGS)_n$ (SEQ ID NO: 9387), $(GGGS)_n$ (SEQ ID NO: 9388), and $(GGGGS)_n$ (SEQ ID NO: 9389) where n can be, for example, an integer from 1 to 10. A peptidyl ligand linker can comprise, for example, $(G)_n$ (SEQ ID NO: 9390), $(GS)_n$ (SEQ ID NO: 9391), $(GGS)_n$ (SEQ ID NO: 9392), $(GGGS)_n$ (SEQ ID NO: 9393), or $(GGGGS)_n$ (SEQ ID NO: 9394), where n is an integer from 1 to 5, such as 1, 2, 3, 4, or 5. For example, a peptidyl ligand linker can be -G-G- (SEQ ID NO: 9399), -G-G- (SEQ ID NO: 9399), -G-G-S- (SEQ ID NO: 9402), -G-G-G-G-S- (SEQ ID NO: 9395), or -G-G-S-G-G-S- (SEQ ID NO: 9405).

A peptidyl ligand linker can be a rigid linker. Rigid linkers can be proline rich and can include other amino acids such as alanine, lysine, and/or glutamic acid. A rigid linker can have the sequence $(PX)_n$ where X can be, for example, alanine, lysine, or glutamic acid, and n can be an integer from 1 to 10 (SEQ ID NO: 9429). Examples of rigid linkers include $(PA)_n$ where n can be, for example, an integer from 1 to 10 (SEQ ID NO: 9423).

IL-7Rα binding compounds comprising a peptidyl ligand linker can be synthesized using non-recombinant methods such as using the solid phase synthesis as described in Example 6 or can be synthesized using recombinant DNA technology.

An IL-7Rα ligand linker can comprise a synthetic chemical ligand linker. A synthetic chemical ligand linker refers to a linker that is synthesized using chemical methods and can include amino acids or may not include amino acids. A synthetic chemical ligand linker can comprise a triazole moiety.

A synthetic chemical ligand linker can have the structure, for example, of Formula (L2)-(L13) as shown in Table 1.

TABLE 1

Chemical ligand linkers.

| Formula No. | Chemical Structure |
|---|---|
| (L1) | [structure] |
| (L2) | [structure] n = 2 |
| (L3) | [structure] |
| (L4) | [structure] n = 2 |
| (L5) | [structure] n = 2 |
| (L6) | [structure] n = 2 |
| (L7) | [structure] m = 4 and n = 2 |
| (L8) | [structure] |
| (L9) | [structure] |

TABLE 1-continued

Chemical ligand linkers.

| Formula No. | Chemical Structure |
|---|---|
| (L10) | [chemical structure] |
| (L11) | [chemical structure] |
| (L12) | [chemical structure] m = 2, n = 1 |
| (L13) | [chemical structure] m = 2, n = 4 |

In ligand linkers (L2), (L4)-(L7), (L12) and L13), m and/or n can be an integer, for example, from 1 to 10.

A synthetic chemical ligand linker can be synthesized using click chemistry to provide homodimeric or heterodimeric IL-7Rα binding compounds having various C/N orientations of the ligands. C/N orientation refers to the terminus of the ligands which are bonded to the ligand linker. For example, for a homodimeric IL-7Rα ligand having a C/N orientation, the C-terminus of a first IL-7Rα ligand is bonded to the ligand linker, and the N-terminus of a second IL-7Rα ligand is bonded to the ligand linker. As another example, for a homodimeric IL-7Rα ligand having an N/C orientation, the N-terminus of a first IL-7Rα ligand is bonded to the ligand linker, and the C-terminus of a second IL-7Rα ligand is bonded to the ligand linker. As another example, for a heterodimeric IL-7Rα/Rγc ligand having a C/N orientation, the C-terminus of the IL-7Rα ligand is bonded to the ligand linker, and the N-terminus of the Rγc ligand is bonded to the ligand linker. As another example, for a heterodimeric IL-7Rα/Rγc ligand having an N/C orientation, the N-terminus of the IL-7Rα ligand is bonded to the ligand linker, and the C-terminus of the Rγc ligand is bonded to the ligand linker.

An example of a synthetic method is described in Example 7.

IL-7Rα ligands can be prepared using standard solid phase peptide synthesis and Fmoc-protected amino acids. A swollen resin can be treated with either an activated solution of Fmoc-propargyl glycine or 2-(Fmoc-NH)-azido-pentanoic acid to provide the corresponding Fmoc-protected resin. The alkyne-containing moiety and the azide-containing moiety can be configured to have, for example, a desired length, rigidity/flexibility, polarity, lipophilicity, and/or steric property. The protected resin can be subjected to repeated cycles of Fmoc-amino acid couplings with HATU activation and Fmoc removal to synthesize the respective IL-7Rα ligand. After Fmoc removal from the final amino acid of the IL-7Rα ligand and acylation of terminal amine groups, the ligands can be cleaved from the resin and purified.

The alkyne-containing moiety and azide-containing moiety can be reacted, for example, in the presence of $CuSO_4$ and a metal chelator to provide an IL-7Rα ligand comprising a synthetic chemical ligand linker. The reacted alkyne-containing moiety and azide-containing moiety form the chemical ligand linker. For example, referring to Tables 2 and 3, an alkyne-containing moiety of Formula (AL) in Table 2 can be reacted with an azide-containing moiety of Formula (AZ) in Table 3 to provide a chemical IL-7Rα ligand linker of Formula (L) in Table 1.

Using this click-chemistry method, dimeric IL-7Rα binding compounds comprising IL-7Rα ligands having differing N-terminal and C-terminal orientations and different ligand linker lengths can be synthesized.

Examples of alkyne-containing moieties are provided in Table 2 and examples of azide-containing moieties are provided in Table 3.

TABLE 2

Examples of alkyne-containing moieties.

| Formula No. | Chemical Structure |
|---|---|
| (AL1) | [structure: methylamine-CH(CONH₂)-(CH₂)₄-NH-C(=O)-CH₂-C≡CH] |
| (AL2) | [structure: ~NH-CH(CONH₂)-C≡CH] |
| (AL3) | [structure: ~C(=O)-CH(CONH₂)-(CH₂)₄-NH-C(=O)-CH₂-C≡CH] |
| (AL4) | [structure: ~C(=O)-C≡CH] |
| (AL5) | [structure: ~NH-CH(CONH₂)-(CH₂)₄-NH-C(=O)-(CH₂CH₂O)$_n$-CH₂CH₂-NH-C(=O)-CH₂-C≡CH], n = 4 |
| (AL6) | [structure: ~NH-[CH₂-C(=O)-NH]$_m$-[CH₂CH₂O]$_n$-CH₂CH₂-C(=O)-NH-CH(CONH₂)-C≡CH], m = 2 and n = 1 |
| (AL7) | [structure: same as AL6], m = 2 and n = 4 |
| (AL8) | [structure: same as AL6], m = 1 to 10, and n = 1 to 10 |
| (AL9) | [structure: ~NH-CH(CONH₂)-[CH₂-CH₂-NH-C(=O)]$_m$-(CH₂CH₂O)$_n$-CH₂CH₂-NH-C(=O)-CH₂-C≡CH], m = 1 to 10, and n = 1 to 10 |

TABLE 3

Examples of azide-containing moieties.

| Formula No. | Chemical Structure |
|---|---|
| (AZ1) | [structure with CONH$_2$, amide linkages, PEG (n=2), terminal N$_3$] |
| (AZ2) | [structure with CONH$_2$ and terminal N$_3$] |
| (AZ3) | [structure with CONH$_2$, amide linkages, PEG (n=2), terminal N$_3$] |
| (AZ4) | [ketone-containing structure with terminal N$_3$] |
| (AZ5) | [structure with CONH$_2$ and terminal N$_3$] |

An IL-7Rα ligand can comprise N- and/or C-terminal modifications to prevent or minimize degradation by aminopeptidases and carboxypeptidases. Examples of terminal groups include an acetyl group on the N-terminus and a carboxamide group on the C-terminus.

IL-7Rα ligands provided by the present disclosure can comprise disulfide bonds. IL-7Rα ligands can comprise at least two cysteines. The at least two cysteines of an IL-7Rα ligand can be bound together through a disulfide bond.

An IL-7Rα ligand provided by the present disclosure can be bound to a naturally occurring protein or to a synthetic molecule to provide an IL-7Rα ligand construct. Examples of suitable construct partners include polymers, proteins, Fc-fragments, immunoglobulin fragments, and antibodies.

An IL-7Rα ligand construct can be configured to provide desired pharmacokinetic properties, provide reduced immunogenicity, to target a specific cell population, and/or to provide enhanced therapeutic efficacy.

An IL-7Rα ligand can be bound to the construct partner through a construct linker.

An IL-7Rα ligand construct can comprise a single IL-7Rα ligand bound to a construct partner or two or more IL-7Rα ligands bound to a construct partner.

Each of the two or more IL-7Rα ligands bound to a construct partner can be the same, or at least one of the IL-7Rα ligands can be different than at least one of the other IL-7Rα ligands bound to the construct partner. The IL-7Rα ligands can differ, for example, with respect to amino acid sequence of the IL-7Rα ligand, the IL-7Rα ligand linker, and/or to the flanking amino acids.

Each of the IL-7Rα ligands can be independently bound to a construct partner through a respective construct linker. Each of the respective construct linkers can be the same, or at least one of the construct linkers can be different than at least one other construct linker. The construct linkers can differ, for example, with respect to the length and/or to the chemical composition.

Each of the IL-7Rα ligands can independently be bound to a construct partner through the N-terminus or the C-terminus of the respective IL-7Rα ligand.

An IL-7Rα ligand construct can comprise a homomeric IL-7Rα ligand and/or heteromeric IL-7Rα ligand bound to a construct partner. The homomeric IL-7Rα ligand and/or heteromeric IL-7Rα ligand can be bound to the construct partner through a construct linker.

An IL-7Rα ligand construct can comprise a single homomeric IL-7Rα ligand and/or heteromeric IL-7Rα ligand bound to a construct partner or two or more homomeric IL-7Rα ligands and/or heteromeric IL-7Rα ligands bound to a construct partner.

Each of the two or more homomeric IL-7Rα ligands and/or heteromeric IL-7Rα ligands bound to a construct partner can be the same, or at least one of the homomeric IL-7Rα ligands and/or heteromeric IL-7Rα ligands can be different than at least one of the other homomeric IL-7Rα ligands and/or heteromeric IL-7Rα ligands bound to the construct partner. The homomeric IL-7Rα ligands can differ, for example, with respect to the IL-7Rα ligands, the IL-7Rα ligand linkers, the homomeric IL-7Rα linkers, and/or the flanking amino acids. The heteromeric IL-7Rα ligands can differ, for example, with respect to the IL-7Rα ligands, the IL-7Rα ligand linkers, the heteromeric IL-7Rα linkers, the heteromeric ligand partners such as the Rγc ligand, and/or the flanking amino acids.

Each of the homomeric IL-7Rα ligands and/or heteromeric IL-7Rα ligands can be bound to a construct partner through a respective construct linker. Each of the respective construct linkers can be the same, or at least one of the construct linkers can be different than at least one other construct linker. The construct linkers can differ, for example, with respect to the length and/or to the chemical composition.

Each of the homomeric IL-7Rα ligands and/or heteromeric IL-7Rα ligands can independently be bound to the construct partner through the N-terminus or the C-terminus of the respective homomeric IL-7Rα ligand and/or heteromeric IL-7Rα ligand.

An IL-7Rα ligand construct can comprise at least one IL-7Rα ligand and at least one homomeric IL-7Rα ligand bound and/or heteromeric IL-7Rα ligand to a construct partner. Each of the at least one IL-7Rα ligands and the at least one homomeric IL-7Rα ligand and/or heteromeric IL-7Rα ligand can independently be bound to the construct partner through a construct linker. For example, an IL-7Rα ligand construct can comprise from 1 to 10 IL-7Rα ligands provided by the present disclosure.

An IL-7Rα ligand construct can compromise one or more IL-7Rα ligands bound to a side chain of a molecule such as an amino acid forming a polymer or protein.

An IL-7Rα ligand construct can compromise one or more IL-7Rα ligands in which the one or more IL-7Rα ligands is incorporated into the backbone of the polymer or polypeptide. Thus, an IL-7Rα ligand construct can comprise one or more IL-7Rα ligands in which the one or more IL-7Rα ligands are bound to a N-terminus of a polypeptide, bound to a C-terminus of a polypeptide, bound to an amino acid side chain of a polypeptide, and/or incorporated into the amino acid sequence of the polypeptide.

An IL-7Rα ligand construct provided by the present disclosure can further comprise one or more Rγc ligands. The one or more IL-7Rα ligands and one or more Rγc ligands can be bound to the construct partner at different locations on the construct partner. An IL-7Rα ligand and a Rγc ligand can be bound together through a ligand linker to form an IL-7Rα/Rγc heteromer and one or more IL-7Rα/Rγc heteromers can be bound to the construct partner directly or through a construct linker. One or more IL-7Rα ligands and one or more Rγc ligands can be incorporated into the polypeptide chain of the construct partner. The one or more IL-7Rα ligands and one or more Rγc ligands and the construct partner can be configured to facilitate interaction with and/or binding to IL-7R such as, for example, to facilitate IL-7R agonist activity.

IL-7Rα ligand constructs provided by the present disclosure include fusion proteins.

Examples of suitable fusion protein partners include Fc-fragments, immunoglobulins such as IgG1, IgG2, and IgG4, immunoglobulin fragments such as IgG1, IgG2, and IgG4 fragments, naturally occurring proteins such as human serum albumin (HSA), antibodies, other human proteins and mutants and/or variants thereof; proteins, and polypeptides. A fusion protein partner can be a naturally occurring protein, a modified-naturally occurring protein, or a synthetic protein.

A fusion partner can be used to provide a desirable pharmacokinetic profile, for cell-targeting, for dual pharmacology, and/or for enhanced efficacy.

For example, an IL-7Rα ligand provided by the present disclosure can be fused to a protein that increases the circulating half-life of the IL-7Rα ligand. Fusion of therapeutic proteins with IgG or the IgG-Fc chain accomplishes this by increasing the hydrodynamic radius of the protein, thus reducing renal clearance, and through Neonatal Fc Receptor (FcRn)-mediated recycling of the fusion protein, thus prolonging the circulating half-life. Other fusion proteins can be designed to modify properties such as the pharmacokinetics, biodistribution, pharmacodynamics, pharmacology, cytotoxicity, and/or targeting.

An IL-7Rα ligand fusion protein provided by the present disclosure can comprise one or more IL-7Rα ligands bound to a fusion protein partner. Each of the one or more IL-7Rα ligands can be independently bound to a fusion protein partner through the N-terminus or through the C-terminus of the respective IL-7Rα ligand. Each of the one or more IL-7Rα ligands can be the same. At least one of the one or more IL-7Rα ligands can be different than at least one other IL-7Rα ligand. The amino acid sequence at the junction between an IL-7Rα ligand and a fusion partner protein can be either a direct fusion of the two protein sequences or can be a fusion with an intervening peptidyl fusion linker. Peptidyl linkers can be included as spacers between an IL-7Rα ligand and the fusion partner. Peptidyl linkers can promote proper protein folding and stability of the component protein and the one or more IL-7Rα ligands, improve protein expression, and/or can enhance bioactivity of the IL-7Rα ligand and/or the fusion partner.

Peptidyl linkers used in IL-7Rα ligand fusion proteins can be designed to be unstructured flexible peptides. Peptidyl linkers can be, for example, rich in glycine and serine, such as repeats of a sequence such as, for example, $(GS)_n$ (SEQ ID NO: 9386), $(GGS)_n$ (SEQ ID NO: 9387), $(GGS)_n$ (SEQ ID NO: 9387), $(GGGS)_n$ (SEQ ID NO: 9388), and $(GGGGS)_n$ (SEQ ID NO: 9389), where n is an integer from 1 to 10. A flexible peptidyl linker with a fully extended β-strand conformation can have an end-to-end length, for example, of 3.5 Å per residue. Thus, a peptidyl linker of 5, 10, 15, or 10 residues can have a maximum fully extended length of 17.5 Å, 35 Å, 52.5 Å, 70 Å, 140 Å, or more than 140 Å, respectively.

Peptidyl linkers can be rigid linkers, such as linkers including proline and other amino acids such as alanine, lysine or glutamic acid. For example, a rigid linker can be $(PA)_n$ where n is an integer 1 to 20 (SEQ ID NO: 9421) such as $(PA)_{10}$ (SEQ ID NO: 9428). A peptidyl linker can facilitate providing an appropriate conformation and orientation of individual fusion protein moieties to facilitate the engagement of an IL-7Rα ligand with IL-7R, facilitate binding of the IL-7Rα ligand to IL-7R, enable fusion protein recycling, and/or prolong the circulating half-life of the IL-7Rα ligand.

There are multiple options for the design and construction of a fusion protein comprising one or more IL-7Rα ligands and which can be selected to obtain an IL-7Rα fusion protein having the desired biological activity and pharmaceutical characteristics. Design options include, for example, the IL-7Rα ligand including the selection of the IL-7Rα ligand and the IL-7Rα ligand linker; the fusion partner protein binding moiety; the configuration of the fusion partner binding moiety in the fusion protein; the peptidyl linker binding an IL-7Rα ligand to the fusion partner; and the fusion partner protein.

In general, preparation of IL-7Rα ligand fusion proteins provided by the present disclosure can be prepared using recognized recombinant DNA techniques involving, for example, polymerase chain amplification reactions (PCR), preparation of plasmid DNA, cleavage of DNA with restriction enzymes, preparation of oligonucleotides, ligation of DNA, isolation of mRNA, introduction of the DNA into a suitable cell, transformation or transfection of a host, and culturing of the host. Additionally, IL-7Rα ligand fusion proteins can be isolated and purified using chaotropic agents and using well-known electrophoretic, centrifugation, and chromatographic methods.

IL-7Rα ligand fusion proteins provided by the present disclosure can comprise one or more small ubiquitin-related modifier (SUMO) proteins. Modification of cellular proteins by the ubiquitin-like modifier SUMO can regulate various cellular processes, such as nuclear transport, signal transduction, and stabilization of proteins. Once covalently attached to cellular targets, SUMO regulates protein/protein and protein/DNA interactions, as well as localizes and stabilizes the target protein.

For example, an IL-7Rα ligand can be bound to a first linker, which is bound to a SUMO protein, which is further bound to a second linker binding the SUMO protein to a fusion partner such as an IgG or Fc-fragment. SUMO fusions can enhance expression, promote solubility, and/or facilitate optimized protein folding. Attachment of a highly stable structure such as that of ubiquitin or SUMO at the N- or C-terminus of a fusion partner protein can increase the yield by increasing stability. The solubilizing effect of ubiquitin and ubiquitin-like proteins may also be explained in part by the outer hydrophilicity and inner hydrophobicity of the core structure of ubiquitin and SUMO, exerting a detergent-like effect on otherwise insoluble proteins.

One or more IL-7Rα ligands can be bound to a compound that provides desired pharmacokinetic properties. For example, one or more IL-7Rα ligands can be bound to a synthetic polymer or to a protein, such as a naturally occurring protein, that exhibits an extended half-life in the systemic circulation.

An IL-7Rα ligand provided by the present disclosure can be conjugated to or fused to molecules that extend the serum half-life of the IL-7Rα ligand without increasing the risk that such half-life extension would increase the likelihood or the intensity of a side-effect or adverse event in a patient. Dosing of extended serum half-life IL-7Rα ligands can allow for prolonged target coverage with lower systemic maximal exposure ($C_{max}$). Extended serum half-life can allow for use of lower administered doses and/or a less frequent dosing regimen of an IL-7Rα binding compound.

The serum half-life of an IL-7Rα ligand can be extended by any suitable method. Such methods include linking an IL-7Rα ligand to a peptide that binds to the neonatal Fc receptor or linking an IL-7Rα ligand to a protein having extended serum half-life such as IgG, an IgG Fc fragment or to human serum albumin (HSA).

Examples of IL-7Rα ligand pharmacokinetic constructs include, (a) recombinantly fusing one or more IL-7Rα ligands to a naturally long-half-life protein or protein domain such as Fc fusion, transferrin fusion or albumin fusion; (b) recombinantly fusing one or more IL-7Rα ligands to an inert polypeptide such as XTEN®, a homoamino acid polymer (HAP, HAPylation), a proline-alanine-serine polymer (PAS, PASylation), an elastin-like peptide (ELP, ELPylation), or a gelatin-like protein GLK polymer; (c) increasing the hydrodynamic radius by chemical conjugation of one or more IL-7Rα ligands to a repeat chemical moiety such as PEGylation or hyaluronic acid; (d) increasing the negative charge of the one or more IL-7Rα ligands by polysialylation or by fusing to a negatively charged highly sialylated peptide such as carboxy-terminal peptide (CTP of chorionic gonadotropin (CG) β-chain); or (e) conjugating of one or more IL-7Rα ligands to a peptide or protein-binding domain of a normally long half-life protein such as human serum albumin (HSA), transferrin, fusion to the constant fragment Fc chain of a human immunoglobulin IgG, or fusion to non-natural polypeptides such as XTEN®.

One or more IL-7Rα ligands can be bound to a synthetic polymer.

For example, an IL-7Rα ligand can be conjugated to polyethylene glycol (PEG) chains (to extend the half-life of the IL-7Rα ligand in the systemic circulation. A PEG can have a molecular weight, for example, from 5 kDa to 100 kD, from 10 kDa to 80 kDa, or from 20 kDa to 60 kDa.

PEGylation can be achieved chemically or enzymatically and the biophysical and biochemical properties of the conjugate can depend, for example, on structure, size, number and location of PEG chains. PEGylation can prolong the circulation half-life of an IL-7Rα ligand by masking proteolytic cleavage sites and/or by increasing their hydrodynamic radii, thereby reducing renal clearance.

An IL-7Rα ligand can be conjugated to either linear or branched-chain monomethoxy polyethylene glycol (mPEG), resulting in increases in the molecular mass and hydrodynamic radius and decrease the rate of glomerular filtration by the kidney. PEG is a highly flexible uncharged, mostly non-immunogenic, hydrophilic, and non-biodegradable molecule, which generates a larger hydrodynamic radius than an equivalently sized protein. PEGylation has been used widely to lengthen the half-life of pharmacologically active compounds.

Similar to IgG, serum albumin displays an unusually long circulation half-life. Half-life prolongation of these functionally and structurally unrelated proteins is derived primarily from interaction with FcRn. Although HSA binds FcRn at a different site than IgG, both interactions are pH-dependent and result in FcRn-mediated rescue from cellular catabolism. IL-7Rα ligand constructs include, for example, genetic fusion to HSA, conjugation to HSA-binding moieties, and fusion to HSA-binding antibodies or antibody fragments.

One or more IL-7Rα ligands can be bound to an XTEN® polypeptide (Amunix Pharmaceuticals Inc.). XTEN® polypeptides are generally 200 amino acids or more in length, are designed to mask antigen binding regions of scFvs, to be unstructured and to have a low immunogenicity. XTEN® polypeptides can increase the circulating half-life of therapeutic agents. One or more IL-7Rα ligands can be bound to an XPAT® polypeptide (Amunix Pharmaceuticals, Inc.). XPAT® polypeptides include substrates for proteases and can be designed to be active with one or more proteases, to select the cleavage rate, and to impart specificity.

Genetic fusing of one or more IL-7Rα ligands to serum transferrin (Tf) can result in enhanced pharmacokinetics. Serum transferrin is an 80 kDa glycoprotein that mediates iron transport from the systemic circulation into cells and tissues. When bound to ferric ions, transferrin displays high affinity for the transferrin receptors (TfRs) displayed on the surface of most cell types. Upon interaction, the Tf/TfR complex is internalized via receptor-mediated endocytosis into endosomes, where iron is released and Tf/TfR is then recycled to the cell surface. Fusion of protein therapeutics to Tf or TfR-binding antibodies can be used for half-life extension, targeting of malignant cells overexpressing TfRs and targeting of the rai capillary endothelium for transport of therapeutics across the blood brain barrier.

Fusion of an IL-7Rα ligand to IgG or Fc can result in increased avidity of the IL-7Rα ligand provides for purification via protein G/A affinity chromatography and can prolong the circulation half-life of the IL-7Rα ligand.

Half-life extension of IL-7Rα ligand/IgG fusion proteins results from a combination of reduced renal clearance due to increased molecular size and FcRn-mediated recycling, where Fc binds FcRn at acidic pH in endosomes and is then released at physiological pH to the plasma.

One or more IL-7Rα ligands can be bound to any suitable IgG including, for example, IgG1, IgG2, or IgG4. The one or more IL-7Rα ligands can be bound to any suitable portion of IgG such as the light chain VL or to the heavy chain VH and including the N-terminus, the C-terminus, an amino acid side chain, or can be incorporated into the amino acid sequence of the light or heavy chain of IgG.

One or more IL-7Rα ligands can be non-covalently bound to albumin. Non-covalent binding of IL-7Rα ligands to albumin can shield the ligands for proteolytic degradation and protect the ligands from rapid renal clearance. The nature of the non-covalent binding allows for the detachment of the IL-7Rα ligand thereby facilitating the ability of the ligand to interact with IL-7R. IL-7Rα ligands can be modified to facilitate non-covalent binding to one or more different albumin binding protein domains that can impart a desired pharmacokinetic property to the IL-7Rα ligand. Alternatively, albumin can be engineering to provide a desired pharmacokinetic profile for an IL-7Rα ligand. These albumin binding domains can be used to improve the pharmacokinetics of larger compounds such as IL-7Rα ligand constructs. An Il-7Rα ligand can be bound to albumin through a albumin binding molecule having, for example, a high affinity to albumin. An albumin binding molecule can be fused to an IL-7Rα ligand either recombinantly or chemically during solid-phase synthesis. Such albumin binding molecules can be small peptide having less than 20 amino acids.

IL-7Rα ligand constructs provided by the present disclosure can comprise IL-7Rα ligand/IgG constructs.

An IgG construct comprises at least one heavy chain and at least one light chain. An IL-7Rα ligand can be bound to the N-terminus of the heavy chain, to the N-terminus of the light chain, or to the N-terminus of the heavy chain, and to the N-terminus of the light chain.

An IL-7Rα ligand can be bound to the C-terminus of the heavy chain, for example, to the CH3 domain, to the N-terminus of the heavy chain and/or to the N-terminus of the light chain.

In an IgG construct, an IL-7Rα ligand can be bound to the N-terminus of one or both heavy chains, to the N-terminus of one or both light chains, and/or to one or both C-termini of the heavy chains.

In an IgG construct, an IL-7Rα ligand can be bound to an amino acid side chain of IgG.

In an IgG construct, an IgG heavy chain and/or an IgG light chain can comprise one or more IL-7Rα ligands incorporated into the amino acid sequence forming the IgG heavy chain and/or the IgG light chain.

Examples of IL-7Rα ligand IgG constructs are shown in Table 4.

In an IL-7Rα construct each linker bonding an IL-7Rα ligand to the IgG can independently be the same or can be different.

For example, an IL-7Rα ligand can be bound to the C-terminus of one or both IgG heavy chains, to the C-terminus of one or both IgG light chains, to the N-terminus of one or both IgG heavy chains, and/or to the N-terminus of one or both IgG light chains. Each of the IL-7Rα ligands can be bound to the IgG through a suitable construct linker.

One or more IL-7Rα ligands can be bound to an IgG fragment such as a single light chain VL domain, a single heavy chain VH domain or to the Fc region. The fragments can be derived from any suitable immunoglobulin such as IgA, IgD, IgE, IgG, or IgM. The fragments can be derived from any suitable IgG such as, for example, IgG1, IgG2, or IgG4.

One or more IL-7Rα ligands can be bound to an Fc-fragment. The Fc-fragment can be monomeric, can be dimeric, or can be a modified Fc-fragment. A dimeric Fc-fragment can comprise one or more disulfide bonds on the N-terminus. An example of a modification is a knob-into-hole modification comprising a knob modification in the CH3 domain of one of the immunoglobulin heavy chain and a hole modification in the other immunoglobulin heavy chain.

Constructs provided by the present disclosure include IL-7Rα ligand-Fc fusion proteins. An Fc chain can include two different polypeptides that self-assemble into either homodimeric Fc chains or heterodimeric Fc chains. The fusion proteins can include an Fc chain, one or more Fc chain linkers, and one or more IL-7Rα ligands. An Fc chain linker binds an IL-7Rα ligand provided by the present disclosure to an Fc chain.

The Fc chain can comprise the Fc chain of any suitable immunoglobulin isotype including IgA, IgD, IgE, IgG, and IgM immunoglobulin isotypes. The Fc-fragment can be derived from any suitable IgG immunoglobulin including, for example, an IgG1, IgG2, or IgG4.

An IL-7Rα ligand Fc-fusion protein can comprise one or more IL-7Rα ligands. Each of the one or more IL-7Rα ligands can be the same or can be different than other IL-7Rα ligands bound to a Fc chain.

An IL-7Rα ligand Fc-fragment construct, i.e., IL-7Rα Fc fusion, can comprise an IL-7Rα ligand bound to the C-terminus of one Fc-chain or to the C-terminus of both Fc-chains of the Fc-fragment.

An IL-7Rα ligand Fc fusion can comprise one IL-7Rα ligand bound to the N-terminus of the Fc-fragment or two IL-7Rα ligands bound to the N-terminus of the Fc-fragment.

An IL-7Rα ligand Fc fusion can comprise one or two IL-7Rα ligands bound to the C-terminus of the Fc-fragment and one or two IL-7Rα ligands can be bound to the N-terminus of the Fc-fragment.

Each IL-7Rα ligand can be covalently bound to an Fc-fragment through an Fc linker. Each Fc linker binding an IL-7Rα ligand to an Fc-fragment can be the same or different.

Each IL-7Rα ligand can independently be bound to an Fc linker through the N-terminus or through the C-terminus of the IL-7Rα ligand.

Examples of IL-7Rα ligand Fc-fragment constructs are shown in Table 4.

An Fc fusion protein can comprise two Fc chains with at least one of the Fc chains comprising a fused IL-7Rα ligand and optionally an Fc-linker. The dimeric Fc-fusion proteins can be configured to have one IL-7Rα ligand, which can be referred to as monovalent IL-7Rα ligand-Fc-fusion, where an IL-7Rα ligand is covalently bound to one of the Fc chains and the other Fc chain is not bound to an IL-7Rα ligand. In a bivalent IL-7Rα ligand Fc-fusion an IL-7Rα ligand is fused to each Fc chain.

In addition to homodimeric bivalent IL-7Rα ligand Fc fusion proteins, in a monovalent IL-7Rα ligand Fc-fusion protein, one Fc chain can be empty and heterodimerization variants can be used to bring the two Fc chains together. These embodiments rely on the use of two different variant Fc sequences, that can self-assemble to form heterodimeric Fc chains and heterodimeric Fc fusion proteins. There are a number of mechanisms that can be used to generate the heterodimers. In addition, these mechanisms can be combined to ensure high heterodimerization. Heterodimerization variants can include steric variants such as knobs and holes or skew variants, charge pairs variants, and pH variants.

IL-7Rα ligand constructs provided by the present disclosure include constructs in which one or more IL-7Rα ligands are bound to a construct partner and independently one or more Rγc ligands are bound to the construct partner. For example, an IL-7Rα ligand can be bound to the C-terminus of an Fc fragment or immunoglobulin and an Rγc ligand can be bound to the N-terminus of an Fc fragment or an immunoglobulin. As another example, an IL-7Rα ligand can be bound to the C-terminus of one heavy chain of an Fc fragment or immunoglobulin and an Rγc ligand can be bound to the other heavy chain of the Fc fragment or immunoglobulin.

A construct comprising one or more IL-7Rα ligands and/or one or more Rγc ligands can comprise one or more heteromeric IL-7Rα/Rγc ligands bound to the construct partner. Each of the ligands can independently be selected from a heterodimeric IL-7Rα/Rγc ligand, an IL-7Rα ligand, or an Rγc ligand.

In constructs comprising a protein or synthetic polymer, one or more IL-7Rα ligands, one or more Rγc ligands, and/or one or more heterodimeric IL-7Rα/Rγc ligands can be bound to the construct partner. For example, the ligands can be bound to the C-terminus and N-terminus of the protein or to the terminal groups of the polymer, and/or to functionalized side chains.

Each of the one or more IL-7Rα ligands and one or more Rγc ligands can independently be bound to a construct partner through a construct linker. The construct linker can be, for example, any of the rigid or flexible linkers disclosed herein, and can be selected to facilitate a desired interaction with IL-7R.

IL-7Rα ligand constructs provided by the present disclosure can comprise a construct linker covalently binding an IL-7Rα ligand to a construct partner including, for example, any of the peptides, polymers, Fc-fragments, immunoglobulin fragments, and antibodies disclosed herein.

A construct linker can be configured to facilitate binding of an IL-7Rα ligand to a binding site on IL-7R. A construct linker can be configured to facilitate activation of IL-7R by an IL-7Rα binding compound and an Rγc binding compound.

A construct linker can be a peptidyl construct linker. A peptidyl construct linker can comprise, for example, from 2 to 30 amino acids, from 2 to 25 amino acids, from 2 to 20 amino acids, from 2 to 15 amino acids or from 2 to 10 amino acids. A peptidyl construct linker can comprise, for example, less than 30 amino acids, less than 25 amino acids, less than 20 amino acids, less than 15 amino acids, less than 10 amino acids, or less than 5 amino acids. A peptidyl construct linker can comprise, for example, more than 2 amino acids, more than 4 amino acids, more than 8 amino acids, more than 12 amino acids, or more than 16 amino acids.

A peptidyl construct linker can have a length, for example, from 5 Å to 500 Å, such as from 10 Å to 400 Å, from 50 Å to 300 Å, or from 100 Å to 200 Å. A peptidyl construct linker can have a length, for example, greater than 5 Å, greater than 10 Å, greater than 50 Å, greater than 100 Å, greater than 200 Å, greater than 300 Å, or greater than 400 Å.

A construct linker can be a chemical construct linker. A chemical construct linker can have a length, for example, from 5 Å to 500 Å, such as from 10 Å to 400 Å, from 5 Å to 300 Å, or from 100 Å to 200 Å. A chemical linker can have a length, for example, greater than 5 Å, greater than 10 Å, greater than 50 Å, greater than 100 Å, greater than 200 Å, greater than 300 Å, or greater than 400 Å.

A chemical construct linker can comprise a backbone comprising, for example, from 3 to 100 bonds, from 5 to 90 bonds, from 10 to 80 bonds, or from 20 to 60 bonds. A chemical construct linker can comprise a backbone comprising, for example, greater than 3 bonds, greater than 5 bonds, greater than 10 bonds greater than 20 bonds greater than 50 bonds, or greater than 100 bonds.

Examples of suitable peptidyl construct linkers include $(G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), and $(GGGGS)_n$ (SEQ ID NO: 9384), where n can be an integer from 1 to 20, such as from 2 to 25, from 2 to 20, from 2 to 16, from 3 to 12, from 4 to 10, or from 6 to 8. A peptidyl construct linker can be, for example, $(GS)_{10}$ (SEQ ID NO: 9407) or $(PA)_{10}$ (SEQ ID NO: 9428).

An IL-7Rα ligand can be bound to a construct linker through the N-terminus or through the C-terminus of the IL-7Rα ligand.

In IL-7Rα ligand constructs having more than one IL-7Rα ligand, each of the IL-7Rα ligands can be bound to the construct partner through an independent construct. Each of the construct linkers can be the same or at least one of the construct linkers can be different. Each of the more than one IL-7Rα ligands can be bound to a respective construct partner through the N-terminus or through the C-terminus of the IL-7Rα ligand.

A construct linker can comprise a cleavable construct linker. A cleavable construct linker can be cleaved in vivo, for example, in the presence of a certain pH, enzymatically, or by application of energy such as by application of electromagnetic radiation including ultraviolet light or infrared irradiation.

An IL-7Rα ligand construct can comprise one or more IL-7Rα ligands bound to an immunoglobulin Fc-fragment. For example, the one or more IL-7Rα ligand constructs can have the amino acid sequence of any one of SEQ ID NOS: 411-419 or 597-655, or an amino acid sequence having greater than 60%, greater than 70%, greater than 80%, greater than 85%, greater than 90%, or greater than 95% amino acid sequence similarity to any one of SEQ ID NOS: 411-419 or 597-655. The IL-7Rα ligands can be bound to the C-terminus and/or to the N-terminus and to one or both of the Fc-chains of the Fc fragment.

The Fc-fragment can be derived, for example, from any suitable immunoglobulin such as hIgG1, hIgG2, hIgG3, or hIgG4.

The N-terminus of the IL-7Rα ligand can be bound to an Fc-fragment through the construct linker. The construct linker can be selected, for example, from $(G)_n$ (SEQ ID NO: 9385), $(GS)_n$ (SEQ ID NO: 9386), $(GGS)_n$ (SEQ ID NO: 9387 $(GGGS)_n$ (SEQ ID NO: 9388), and $(GGGGS)_n$ (SEQ ID NO: 9389), where n is an integer from 1 to 10, such as from 1 to 6 or from 1 to 3. The construct linker can be selected, for example, from $(P)_n$ (SEQ ID NO: 9420) or $(PA)_n$ (SEQ ID NO: 9421) where n is an integer from 1 to 20. A construct linker can comprise $(PX)_n$ where each X can independently be selected from alanine, lysine, and glutamic acid. A construct linker can comprise, for example, $(PA)_n$ (SEQ ID NO: 9423) where n can be, for example, an integer from 1 to 10. Each construct linker can be selected such that an IL-7Rα ligand to which it is bound in combination with an Rγc ligand is an IL-7R agonist. The linker can be, for example (GGGGS)$_n$ (SEQ ID NO: 9394) where n is an integer from 1 to 5.

Functionally, IL-7Rα binding compounds can be IL-7R agonists, IL-7R antagonists, diagnostic reagents, imaging reagents, targeting compounds, cytotoxic compounds, and compounds exhibiting dual pharmacology.

IL-7Rα binding compounds provided by the present disclosure can be attached to one or more moieties that impart a property to the compound that enhances therapeutic efficacy. Examples of properties include potency, aqueous solubility, polarity, lipophilicity, pharmacokinetics, targeting, bioavailability, pH-dependent binding, bioactivity, pharmacodynamics, cellular activity, metabolism, efficacy, reversible incapacitation (caging), selectivity, or a combination of any of the foregoing.

IL-7Rα binding compounds can comprise one or more moieties that are cleavable in vivo. The moiety can be cleavable in a target specific environment such as, for example, by a target specific or target enriched enzyme, or pH. The moiety can be cleavable upon exposure to electromagnetic energy such as visible light or infrared radiation and/or by exposure to thermal energy.

IL-7Rα binding compounds can include a tumor-targeting moiety such as, for example, a tumor-specific antibody, a tumor-specific antibody fragment, a tumor-specific protein, a tumor-specific peptide, a non-peptidyl tumor cell ligand, or a combination of any of the foregoing.

IL-7Rα binding compounds can include an immune cell-targeting moiety such as, for example, an immune cell-specific antibody, an immune cell-specific antibody fragment, an immune cell-specific protein, an immune cell-specific peptide, a non-peptidyl immune cell-ligand, or a combination of any of the foregoing.

IL-7Rα binding compounds provided by the present disclosure can include compounds that act as IL-7R agonists.

An IL-7R agonist provided by the present disclosure can comprise synthetic peptides or recombinant peptides linked in tandem to create a single chain peptide comprising an IL-7Rα ligand and, in the case of an IL-7R agonist, an Rγc ligand. The ligands can be in any order and can be separated by amino acid linkers. The synthetic peptides can comprise natural amino acids or peptides with natural amino acids and suitable substitutions with unnatural amino acids. IL-7R agonists provided by the present disclosure can be a recombinant fusion protein comprising an IL-7Rα ligand and an Rγc ligand, and a fusion partner such as an Fc protein, an IgG protein, human serum albumin or other natural or designed protein, or a hydrophilic, biodegradable protein polymer. An IL-7R agonist can comprise one or more IL-7Rα ligands and one or more Rγc ligands. An IL-7R agonist can comprise an IL-7Rα ligand and an Rγc ligand and can further include one or more moieties selected to modify the pharmacokinetics of the IL-7R agonist such as PEG or an albumin binding moiety.

An IL-7R agonist can bind to IL-7Rα subunit and Rγc subunit and can activate the IL-7 receptor. The IL-7R agonist can bind to the IL-7Rα subunit and to Rγc subunit with an IC$_{50}$, for example, less than 100 μM, less than 10 μM, less than 1 μM, less than 100 nM, less than 10 nM, or less than 1 nM. An IL-7R agonist can bind to the IL-7Rα subunit and/or to the Rγc either competitively or non-competitively with IL-7.

An IL-7R agonist comprising an IL-7Rα ligand and an Rγc ligand can be configured to more potently activate cells expressing the IL-7Rα subunit and the Rγc subunit, thereby facilitating the ability to differentially activate IL-7R expressed on the surface of different cell types by controlling dose of the agonist. For example, when incubated with a heteromeric compound comprising an IL-7Rα ligand and Rγc ligand, primary human peripheral blood mononuclear cells (PBMC) expressing the IL-7R subunits phosphorylate signal transducer and activator of transcription 5 (STAT5). A heteromer can comprise an IL-7Rα ligand, an Rγc ligand, and a linker, where the linker is configured such that the heteromer is an agonist for IL-7R. A linker can comprise a length that facilitates binding of an IL-7Rα ligand and an Rγc ligand to IL-7R. For example, a linker can have a length from 10 Å to 400 Å, from 10 Å to 300 Å, from 10 Å to 200 Å, 20 Å to 100 Å, from 30 Å to 80 Å, or from 40 Å to 60 Å. A linker can comprise a chemical structure that facilitates simultaneous binding of an IL-7Rα ligand and an Rγc ligand to the respective IL-7Rα and Rγc subunits. For example, a linker can comprise a peptide or a hydrocarbon.

An IL-7R agonist can partially activate the IL-7 receptor. Partial activation refers to a level of activation, that is, for example, less than 75% of maximum activation, less than 50%, less than 25%, less than 10%, or less than 1% of the maximum activation. Maximum activation ($E_{max}$) is the amplitude of cellular signal (activation) achievable at high agonist concentration such as a high concentration of IL-7. Partial IL-7R agonists can be effective in modulating the levels of response of IL-7R to activation of the IL-7Rα and Rγc subunits among different cell types expressing IL-7R. For example, different cell types are known to vary in expression levels of each of the IL-7R subunits, i.e, the IL-7Rα and Rγc subunits, and to exhibit different sensitivities to IL-7R agonists.

An IL-7R agonist can comprise an IL-7Rα ligand and a modified Rγc ligand. Modified Rγc ligands can be selected or designed to bind and activate IL-7R, but with low or modest affinity and potency to IL-7R. Such IL-7R agonists can have greater differential sensitivity for IL-7R activation between cells that highly express IL-7Rα and cells having a low level of IL-7Rα expression.

An IL-7R agonist can comprise one or more IL-7Rα ligands and one or more Rγc ligands. The presence of multiple IL-7Rα ligands and multiple Rγc ligands can preferentially increase the potency of the IL-7R agonists on cells that highly express IL-7Rα and/or Rγc compared to cells having low expression levels of IL-7Rα and/or Rγc.

An IL-7R agonist can comprise a moiety having an additional pharmacological activity other than that mediated by activation of the IL-7 receptor. The pharmacological activity can be an activity that has a therapeutic efficacy that is synergistic with that of the IL-7R agonist or the pharmacological activity can be an activity that has a therapeutic efficacy that is not synergistic with that of the IL-7R agonist. For example, a moiety or molecule having a useful pharmacological activity can comprise a checkpoint inhibitor.

IL-7Rα binding compounds provided by the present disclosure include IL-7R antagonists. An IL-7R antagonist is a compound comprising an IL-7Rα ligand that inhibits binding of IL-7 and mutants and modified forms thereof, to the IL-7Rα subunit and/or diminishes IL-7 activation of IL-7R.

IL-7R antagonists can attenuate the sensitivity of cells expressing the IL-7Rα subunit to activation by IL-7 or mutants and modified forms thereof.

IL-7R antagonists can include compounds having more than one IL-7Rα ligand or more than one Rγc ligand and can bind competitively or non-competitively with IL-7 to IL-7R.

IL-7R antagonists can comprise one or more IL-7Rα ligands and one or more Rγc ligands and a moiety having a useful pharmacological activity. The moiety can exhibit a pharmacological activity that is synergistic with IL-7R inhibition or is not synergistic with inhibition of IL-7R.

IL-7R antagonists can further include recombinant fusion proteins.

IL-7Rα binding compounds include diagnostic reagents. As a diagnostic agent, a compound comprising an IL-7Rα ligand can be used to detect and/or to measure cells expressing the IL-7Rα subunit. The compounds can be used to determine the level of IL-7Rα expression of a cell, or population of cells, or of a tissue. The compounds can be used to assess the binding affinity of the IL-7Rα subunit to a cell or population of cells. The compounds may be used to determine the particular type of cell, for example, based on IL-7Rα expression levels.

The compounds can be useful for in vitro and in vivo diagnostics.

A diagnostic IL-7Rα binding compound can comprise a detectable marker. The detectable marker can be cleavable or non-cleavable.

A detectable marker can comprise, for example, a radiolabel, a fluorescent label, an enzymatic label.

A diagnostic IL-7Rα binding compound can be used to measure cells expressing the IL-7Rα subunit and/or the level of expression of cells expressing the IL-7Rα subunit in a biological sample such as a sample of blood of a patient. Measurements can be made, for example, using flow cytometry. The number of cells expressing the IL-7Rα subunit and/or the expression level of the IL-7Rα subunit, when correlated with a disease in a patient or a pharmacologically significant parameter of the disease in a patient can be used to inform treatment of the disease. For example, if a level of expression of the IL-7Rα subunit is above or below a therapeutically meaningful threshold for a particular disease, a compound comprising an IL-7Rα ligand provided by the present disclosure can be administered to the patient to treat the disease.

IL-7Rα binding compounds can be attached to a solid support. Based on the ability of the compounds to bind to the IL-7Rα subunit, the compounds can be used as reagents for detecting IL-7Rα subunits, for example, on living cells, fixed cells, in biological fluids, in tissue homogenates, in purified, and natural in biological materials. In addition, based on their ability to bind the IL-7Rα subunit, the peptides of the present invention can be used, for example, in in situ staining, FACS (fluorescence-activated cell sorting), Western Blotting, and ELISA. In addition, compounds provided by the present disclosure can be used in receptor purification, or to purify cells expressing the IL-7Rα subunit on the cell surface.

IL-7Rα binding compounds provided by the present disclosure can also be used as reagents for various medical research and diagnostic uses. Such uses include, for example, use as a calibration standard for quantitating the activities of candidate IL-7R agonists or IL-7R antagonists in functional assays; use to maintain the proliferation and growth of IL-7-dependent cell lines; (3) use in structural analysis of the IL-7 receptor through co-crystallization; use to investigate the mechanism of IL-7 signal transduction/receptor activation; and other research and diagnostic applications wherein the IL-7 receptor is implicated.

Assessing single patient response to therapy and qualifying a patient for optimal therapy are among the greatest challenges of modern healthcare and relate to trends in personalized medicine. IL-7Rα binding compounds can have target selectivity for diseases in which cells associated with the etiology of the disease express the IL-7Rα subunit. For example, a compound comprising an IL-7Rα ligand radiolabeled for positron emission tomography (PET) or single photon emission computed tomography (SPECT) can be used to predict the targeting of the treatment based on a single-study, case-by-case patient analysis thus excluding subjects that are expected not to benefit from treatment with a therapeutic compound affecting the activity of the IL-7Rα subunit. PET/SPECT scans using radiolabeled a compound comprising an IL-7Rα ligand, once correlated to the concentration of a compound comprising an IL-7Rα ligand can provide a three-dimensional distribution map, which can then be used for macroscopic dose calculations.

IL-7Rα binding compounds can comprise one or more imaging agents. The IL-7Rα ligand can direct and localize the compound to cells, populations of cells, and tissue expressing the IL-7Rα subunit. The imaging compounds can comprise one or more imaging agents such as radiolabels, fluorescent labels, enzymatic labels, or PET imaging agents.

The imaging agents can be used to determine the number of cells expressing the IL-7Rα subunit, the expression level of cells expressing the IL-7Rα subunit, or properties of the IL-7Rα subunit such as the affinity of the IL-7Rα subunit to a particular IL-7Rα ligand and/or compound comprising an IL-7Rα ligand. The imaging agents can be used, for example, to evaluate cancer cells expressing IL-7Rα subunit, or to evaluate Treg and/or Teff cells.

The label can be detected to determine a biodistribution of the compound in a patient or to assess the potential for therapeutic efficacy. For example, tumors expressing high levels of the IL-7Rα subunit may be attractive targets for therapeutic compounds comprising an IL-7Rα ligand provided by the present disclosure.

The imaging agents can be used to evaluate cells expressing the IL-7Rα subunit before therapy, during therapy, and/or following therapy.

Imaging agents comprising an IL-7Rα ligand can further comprise a moiety capable of binding to a cell surface and in particular to a protein expressed on the cell surface. The protein can be indicative of a certain cell type and is referred to as a cell surface marker. Imaging agents comprising both an IL-7Rα ligand and a cell surface marker can be used to assess cells, a population of cells, and/or a tissue expressing both the IL-7Rα subunit and the cell surface marker. Assessment can include determining the number of cells expressing both the IL-7Rα subunit and the cell surface marker, the expression levels of the IL-7Rα subunit and the cell surface marker, and/or the affinity of the imaging agent to the IL-7Rα subunit and/or the cell surface marker.

The imaging agents can be used to evaluate cells expressing the IL-7Rα subunit and the cell surface marker before therapy, during therapy, and/or following therapy.

Compounds provided by the present disclosure can be labeled. Labeled compounds can be useful in diagnostics.

IL-7Rα binding compounds provided by the present disclosure can be labeled with a detectable marker. The label can be used to determine a biodistribution of the compound in a patient or to assess the potential for therapeutic efficacy. For example, tumors expressing high levels of IL-7R may be attractive targets for selective IL-7R agonists and compounds comprising an IL-7Rα ligand provided by the present disclosure.

Thus, compounds provided by the present disclosure include labeled compounds. A labeled compound can be a detectable marker, for example, a radiolabeled amino acid or an attachment of biotinyl moieties to a polypeptide, wherein said attached biotinyl moieties can be detected by marked avidin (e.g., streptavidin containing a fluorescent marker or enzymatic activity that can be detected by optical or colorimetric methods). Various methods of labeling polypeptides and glycoproteins are known in the art and may be used. Examples of labels for polypeptides include, for example, a radioisotope such as, $^3$H, $^{14}$C, $^{35}$S, $^{125}$I and $^{131}$I, a fluorescent labels such as FITC, rhodamine, and lanthanide phosphors, an enzymatic label such as horseradish peroxidase, β-galactosidase, luciferase, and alkaline phosphatase, biotinyl groups, predetermined polypeptide epitopes recognized by a secondary reporter such as leucine zipper pair sequences, binding sites for secondary antibodies, metal ligands, and epitope tags. A label can be attached by spacer arms of various lengths to reduce potential steric hindrance.

IL-7Rα binding compounds can comprise a cell-specific targeting moiety or molecule.

A cell-specific targeting moiety can comprise a moiety that has an affinity for a component on the surface of a cell such as a receptor, a protein, or an epitope. A moiety can comprise, for example, a ligand or an antibody having an affinity to a cell surface component.

The targeting moiety can direct and concentrate compounds comprising an IL-7Rα ligand at the cells, population of cells, or tissue targeted by the targeting moiety.

The targeting moiety can enhance the potency of IL-7R agonism or IL-7R antagonism for the cells or population of cells being targeted.

The targeting moiety can provide a differential response to IL-7R agonism or to IL-7R antagonism between the cells being targeted and the cells not being targeted by the targeting moiety.

The targeting moiety can provide a differential response to IL-7R agonism or IL-7R antagonism between cells having a high expression level of the targeted component and cells having a lower expression level of the targeted component.

IL-7Rα binding compounds can further comprise a bioactive moiety or a bioactive molecule. A compound comprising an IL-7Rα ligand can be used to deliver the bioactive moiety or bioactive molecule to cells, to a population of cells, or to a tissue expressing the IL-7Rα subunit.

The bioactive moiety or molecule can be non-cleavable and capable of exerting a biological activity when bound to the compound comprising an IL-7Rα ligand.

The bioactive moiety or molecule can be cleavable. The moiety can be cleavable by any suitable mechanism such as by pH, enzymatic, thermal, and/or electromagnetic mechanisms. Electromagnetic mechanisms include, for example, exposing the compounds to infrared, visible, or ultraviolet radiation, where the bioactive moiety is attached to the compounds comprising IL-7Rα ligand through a photolabile moiety capable of being cleaved by the radiation.

The bioactive molecule can be non-cleavable but otherwise activatable, such as for example, activatable by exposure to electromagnetic radiation.

IL-7Rα ligands can be selected to have enhanced binding to the IL-7Rα subunit at a certain pH. For example, a pH-selective IL-7Rα ligand can have a greater affinity to the IL-7Rα subunit, respectively, at low pH commensurate with that of a solid tumor microenvironment. Compounds comprising low-pH selective IL-7Rα ligands can be used to preferentially activate cells in low pH environments expressing the IL-7Rα subunit compared to cells in normal pH environments associated with healthy tissue.

Thus, compounds comprising selective IL-7Rα ligands such as pH-selective IL-7Rα ligands can be used with other pH-selective bioactive moieties and molecules.

A bioactive moiety or bioactive molecule can itself be selective for a particular cell population. For example, a bioactive moiety or bioactive molecule can exhibit a greater or lesser affinity, potency, and/or activity at the cell being targeted by a selective IL-7Rα ligand. For example, the bioactive moiety or molecule can exhibit greater bioactivity in a low pH tumor microenvironment when targeted by a pH-selective an IL-7Rα ligand. In this example, the bioactive moiety is directed to cells located in the low-pH tumor microenvironment that express the IL-7Rα subunit by the pH-selective IL-7Rα ligand. Thus, the activity of the pH-selective bioactive moiety is enhanced in the low-pH tumor microenvironment.

Compounds comprising an IL-7Rα ligand can further comprise a cytotoxic moiety or cytotoxic molecule. Such compounds can be used to deliver a cytotoxic moiety or compound to a cell expressing the IL-7Rα subunit such as T-cells. The cytotoxic moiety or molecule can exert cytotoxicity when bound to the compound or can be cleavable and the moiety or molecule can be cytotoxic when released from the compound; or the cytotoxic moiety can be activated by electromagnetic radiation.

The cytotoxic moiety or molecule can be used to deplete cells expressing the IL-7Rα subunit being targeted.

IL-7Rα ligand-containing cytotoxic compounds can have more than one IL-7Rα ligand and thereby can exhibit a higher affinity and/or selectivity to cells, populations of cells, and tissue that highly express the IL-7Rα subunit compared to cells having a lower expression level of the IL-7Rα subunit.

IL-7Rα ligand-containing cytotoxic compounds can further include a cell surface targeting component. Such cytotoxic compounds can exhibit enhanced efficacy to cells, populations of cells, and tissue expressing the IL-7Rα subunit and the surface target component.

Examples of suitable cytotoxic molecules include anti-microtubule agents, alkylating agents, and DNA minor groove binding agents.

IL-7Rα binding compounds can further comprise a moiety having a useful pharmacological activity unrelated to IL-7 activity.

The pharmacological moiety can function synergistically with IL-7R agonist activity or synergistically with IL-7R antagonist activity or the pharmacology moiety may not exhibit synergism with activity of the IL-7Rα subunit.

Examples of suitable pharmacological moieties include antibodies and antibody fragments that are inhibitors of checkpoint molecules, pro-apoptotic and anti-apoptotic molecules, cytotoxic molecules, agonists of chemokine, antagonists of chemokine, cytokine, growth factor and other cell surface receptors, and ligands and inhibitors of cell surface adhesion molecules such as integrins.

Peptides provided by the present disclosure can be synthesized by methods known in the art, for example, by using standard solid phase techniques.

A peptide comprising an IL-7Rα ligand provided by the present disclosure can be modified, for example, by phosphorylation, and by other methods known in the art. Thus, the peptides provided by the disclosure can also serve as a basis to prepare peptide mimetics with similar biological activity.

A variety of techniques are available for constructing peptide mimetics with the same or similar desired biological activity as a corresponding peptide but with more favorable activity than the peptide with respect to solubility, stability, and susceptibility to hydrolysis and proteolysis.

IL-7Rα binding compounds provided by the present disclosure, can be incorporated into pharmaceutical compositions to be administered to a patient by any appropriate route of administration including intradermal, intramuscular, intraperitoneal, intravenous, subcutaneous, intranasal, epidural, oral, peroral, sublingual, intracerebral, intravaginal, transdermal, rectal, inhalation, or topical. A pharmaceutical composition provided by the present disclosure can be an injectable formulation. Pharmaceutical compositions provided by the present disclosure can be injectable intravenous formulations. Pharmaceutical compositions provided by the present disclosure can be oral formulations. Oral formulations may be oral dosage forms. A pharmaceutical composition may be formulated for intravenous administration or for subcutaneous administration.

Pharmaceutical compositions provided by the present disclosure may comprise a therapeutically effective amount of an IL-7Rα binding compound together with a suitable amount of one or more pharmaceutically acceptable vehicles so as to provide a composition for proper administration to a patient. Suitable pharmaceutical vehicles and methods of preparing pharmaceutical compositions are described in the art.

Assessing single patient response to therapy and qualifying a patient for optimal therapy are among the greatest challenges of modern healthcare and relate to trends in personalized medicine. IL-7Rα binding compounds can have target selectivity, for example, for certain cancers and immune cells. IL-7Rα binding compounds radiolabeled for positron emission tomography (PET) or Single Photon Emission Computed Tomography (SPECT) can be used to predict the targeting of the treatment based on a single-study, case-by-case patient analysis thus excluding patients that are expected not to benefit from treatment. PET/SPECT scans using IL-7Rα binding compounds, once correlated to the concentration can provide a three-dimensional distribution map, which can then be used for macroscopic dose calculations.

Accordingly, it is within the capability of those of skill in the art to assay and use IL-7Rα binding compounds and/or pharmaceutical compositions thereof for therapy.

IL-7Rα binding compounds, and/or pharmaceutical composition thereof can generally be used in an amount effective to achieve the intended purpose. For use to treat a disease such as cancer, an autoimmune disease or an inflammatory disease, an IL-7Rα binding compound, and/or pharmaceutical composition thereof, may be administered or applied in a therapeutically effective amount.

The amount of an IL-7Rα binding compound, and/or pharmaceutical composition of any of the foregoing that will be effective in the treatment of a particular disorder or condition disclosed herein will depend in part on the nature of the disorder or condition, and can be determined by standard clinical techniques known in the art. In addition, in vitro or in vivo assays may optionally be employed to help identify optimal dosage ranges. The amount of an IL-7Rα binding compound, and/or pharmaceutical composition of any of the foregoing administered will depend on, among other factors, the patient being treated, the weight of the patient, the severity of the affliction, the manner of administration and the judgment of the prescribing physician.

An IL-7Rα binding compound can be assayed in vitro and in vivo, for the desired therapeutic activity, prior to use in humans. For example, in vitro assays may be used to determine whether administration of a specific compound or a combination of compounds is preferred. The compounds can also be demonstrated to be effective and safe using animal model systems.

In certain embodiments, a therapeutically effective dose of an IL-7Rα binding compound, and/or pharmaceutical composition of any of the foregoing will provide therapeutic benefit without causing substantial toxicity. Toxicity of an IL-7Rα binding compound, and/or pharmaceutical compositions of any of the foregoing may be determined using standard pharmaceutical procedures and may be readily ascertained by the skilled artisan. The dose ratio between toxic and therapeutic effect is the therapeutic index. An IL-7Rα binding compound, and/or pharmaceutical composition of any of the foregoing exhibits a particularly high therapeutic index in treating disease and disorders. A dose of an IL-7Rα binding compound, and/or pharmaceutical composition of any of the foregoing will be within a range of circulating concentrations that include an effective dose with minimal toxicity.

An IL-7Rα binding compounds provided by the present disclosure or a pharmaceutical composition thereof may be included in a kit that may be used to administer the compound to a patient for therapeutic purposes. A kit may include a pharmaceutical composition comprising an IL-7Rα binding compounds provided by the present disclosure suitable for administration to a patient and instructions for administering the pharmaceutical composition to the patient. The kit can be a kit for treating cancer, for treating an autoimmune disease, or for treating an inflammatory disease. A kit for use in treating cancer in a patient can comprise an IL-7Rα binding compound provided by the present disclosure, a pharmaceutically acceptable vehicle for administering the compound, and instructions for administering the compound to a patient.

The pharmaceutical compositions can be included in a container, pack, or dispenser together with instructions for administration.

Instructions supplied with a kit may be printed and/or supplied, for example, as an electronic-readable medium, a video cassette, an audiotape, a flash memory device, or may be published on an internet web site or distributed to a patient and/or health care provider as an electronic communication.

IL-7Rα binding compounds provided by the present disclosure can be used, for example, to treat diseases such as cancer, an inflammatory disease, or an autoimmune disease.

IL-7Rα binding compounds provided by the present disclosure may be used for treating cancer in a patient. The cancer can be, for example, a solid tumor or a metastasis.

IL-7Rα binding compounds provided by the present disclosure or a pharmaceutical composition thereof may be administered to treat a cancer known to be treated by activation of IL-7R. IL-7Rα binding compounds provided by the present disclosure or a pharmaceutical composition thereof may be administered to treat a cancer known to be treated by activation of the IL-7Rα.

IL-7Rα binding compounds provided by the present disclosure or pharmaceutical compositions thereof can be used to treat, for example, one or more of the following cancers: acute lymphoblastic leukemia, acute myeloid leukemia, adrenocortical carcinoma, appendix cancer, astrocytoma, atypical teratoid/rhabdoid tumor, basal cell carcinoma (non-melanoma), B-cell lymphoma, bladder cancer, bone cancer, brain and spinal cord tumors, brain stem cancer, brain tumor, breast cancer, bronchial tumors, Burkitt lymphoma, carcinoid tumor, carcinoma of head and neck, central nervous system embryonal tumors, cerebellar astrocytoma, cerebral astrocytoma/malignant glioma, cervical cancer, chordoma, chronic lymphocytic leukemia, chronic myelogenous leukemia, colorectal cancer, craniopharyngioma, cutaneous T-cell lymphoma, desmoplastic small round cell tumor, ductal carcinoma, dye cancer, endocrine pancreas tumors (islet cell tumors), endometrial cancer, ependymoblastoma, esophageal cancer, esthesioneuroblastoma, Ewing family of tumors, extracranial germ cell tumor, extrahepatic bile duct cancer, gallbladder cancer, gastric cancer, gastrointestinal carcinoid tumor, gastrointestinal stromal tumor, gestational trophoblastic tumor, glioblastoma, glioma, hairy cell leukemia, head and neck cancer, heart cancer, hematopoetic tumors of the lymphoid lineage, hepatocellular cancer, Hodgkin lymphoma, hypopharyngeal cancer, hypothalamic and visual pathway glioma, IDs-related lymphoma, intraocular melanoma, islet cell tumors, Kaposi sarcoma, kidney cancer, Langerhans cell histiocytosis, laryngeal cancer, leukemia, lip and oral cavity cancer, male breast cancer, malignant fibrous histiocytoma, malignant germ cell tumors, malignant mesothelioma, medulloblastoma, melanoma, Merkel cell carcinoma, mesothelioma, mouth cancer, multiple endocrine neoplasia syndrome, multiple myeloma, mycosis fungoides, myelodysplastic, myeloproliferative neoplasms, nasal cavity and paranasal sinus cancer, nasopharyngeal cancer, neuroblastoma, non-Hodgkin lymphoma, non-small cell lung cancer, oral cancer, oropharyngeal cancer, osteosarcoma, ovarian cancer, ovarian epithelial cancer, ovarian germ cell tumor, ovarian low malignant potential tumor, pancreatic cancer, pancreatic neuroendocrine tumors (islet cell tumors), papillomatosis, paraganglioma, paranasal sinus and nasal cavity cancer, parathyroid cancer, penile cancer, pharyngeal cancer, pheochromocytoma, pineal parenchymal tumors, pineoblastoma and supratentorial primitive neuroectodermal tumors, pituitary tumor, plasma cell neoplasm/multiple myeloma, pleuropulmonary blastoma, pregnancy and breast cancer, primary central nervous system lymphoma, primary liver cancer, primary metastatic squamous neck cancer with occult, prostate cancer, rectal cancer, renal cell cancer, renal pelvis and ureter, respiratory tract carcinoma, retinoblastoma, rhabdomyosarcoma, salivary gland cancer, sarcoma, Sézary syndrome, skin cancer, small intestine cancer, soft tissue sarcoma, squamous cell carcinoma (nonmelanoma), stomach cancer, supratentorial primitive neuroectodermal tumors, T-cell lymphoma, testicular cancer, throat cancer, thymoma and thymic carcinoma, thyroid cancer, transitional cell cancer, urethral cancer, uterine sarcoma, vaginal cancer, visual pathway and hypothalamic glioma, vulvar cancer, Waldenström macroglobulinemia, Wilms tumor, and systemic and central metastases of any of the foregoing.

IL-7Rα binding compounds provided by the present disclosure or pharmaceutical compositions thereof can be used to treat solid tumors.

IL-7Rα binding compounds provided by the present disclosure or pharmaceutical compositions thereof can be used to treat tumor metastases.

IL-7Rα binding compounds provided by the present disclosure or pharmaceutical compositions thereof can be used to treat circulating tumor cells.

IL-7Rα binding compounds provided by the present disclosure or pharmaceutical compositions thereof can be used to treat, for example, a cancer selected from primary adult and childhood brain and CNS cancers including glioblastoma (GBM) and astrocytoma, skin cancers including melanoma, lung cancers including small cell lung cancers, non-small cell lung cancers (NSCLC), and large cell lung cancers, breast cancers including triple negative breast cancer (TNBC), blood cancers including myelodysplastic syndrome (MDS), multiple myeloma (MM), and acute myeloid leukemia (AML), prostate cancer including castrate resistant prostate cancer (CRPC), liver cancers including hepatocellular carcinoma (HCC), esophageal and gastric cancers, and any systemic and central metastases of any of the foregoing.

The amount of an IL-7Rα binding compound provided by the present disclosure, or pharmaceutical composition thereof that will be effective in the treatment of a cancer can depend, at least in part, on the nature of the disease, and may be determined by standard clinical techniques known in the art. In addition, in vitro or in vivo assays may be employed to help identify optimal dosing ranges. Dosing regimens and dosing intervals may also be determined by methods known to those skilled in the art. The amount of an IL-7Rα binding compound provided by the present disclosure administered may depend on, among other factors, the patient being treated, the weight of the patient, the severity of the disease, the route of administration, and the judgment of the prescribing physician.

For systemic administration, a therapeutically effective dose may be estimated initially from in vitro assays. Initial doses may also be estimated from in vivo data, e.g., animal models, using techniques that are known in the art. Such information may be used to more accurately determine useful doses in humans. One having ordinary skill in the art may optimize administration to humans based on animal data.

A dose of an IL-7Rα binding compound provided by the present disclosure and appropriate dosing intervals may be selected to maintain a sustained therapeutically effective concentration of the IL-7Rα binding compound provided by the present disclosure in the blood of a patient, and in certain embodiments, without exceeding a minimum adverse concentration.

A pharmaceutical composition comprising an IL-7Rα binding compound provided by the present disclosure may be administered, for example once per week, every 2 weeks, every 3 weeks, every 4 weeks, every 5 weeks, or every 6 weeks. Dosing may be provided alone or in combination with other drugs and may continue as long as required for effective treatment of the disease. Dosing may also be undertaken using continuous or semi-continuous administration over a period of time. Dosing includes administering a pharmaceutical composition to a mammal, such as a human, in a fed or fasted state.

A pharmaceutical composition may be administered in a single dosage form or in multiple dosage forms or as a continuous or an accumulated dose over a period of time. When multiple dosage forms are used the amount of an IL-7Rα binding compound provided by the present disclosure contained within each of the multiple dosage forms may be the same or different.

Suitable daily dosage ranges for administration can range, for example, from about 2 µg to about 200 mg of an IL-7Rα binding compound provided by the present disclosure per kilogram body weight.

Suitable daily dosage ranges for administration may range, for example, from about 1 µg to about 50 mg of an IL-7Rα binding compound provided by the present disclosure per square meter ($m^2$) of body surface.

An IL-7Rα binding compound provided by the present disclosure may be administered to treat cancer in a patient in an amount, for example, from 0.001 mg/day to 100 mg/day, or in any other appropriate daily dose. A dose can be, for example, from 0.01 µg/kg body weight/week to 100 µg/kg body weight/week or any other suitable dose.

A pharmaceutical composition comprising an IL-7Rα binding compound provided by the present disclosure may be administered to treat cancer in a patient so as to provide a therapeutically effective concentration of an IL-7Rα binding compound provided by the present disclosure in the blood or plasma of the patient. A therapeutically effective concentration of a compound of an IL-7Rα binding compound provided by the present disclosure in the blood of a patient can be, for example, from 0.01 µg/L to 1,000 µg/L, from 0.1 µg/L to 500 µg/L, from 1 µg/L to 250 µg/L, or from about 10 µg/L to about 100 µg/L. A therapeutically effective concentration of an IL-7Rα binding compound provided by the present disclosure in the blood of a patient can be, for example, at least 0.01 µg/L, at least 0.1 µg/L, at least 1 µg/L, at least about 10 µg/L, or at least 100 µg/L. A therapeutically effective concentration of an IL-7Rα binding compound in the blood of a patient can be, for example, less than an amount that causes unacceptable adverse effects including adverse effects to homeostasis. A therapeutically effective concentration of an IL-7Rα binding compound in the blood of a patient can be an amount sufficient to restore and/or maintain homeostasis in the patient.

Pharmaceutical compositions comprising an IL-7Rα binding compound may be administered to treat a disease in a patient so as to provide a therapeutically effective concentration of the IL-7Rα binding compound in the blood of a patient for an extended period of time such as, for example, for at least 1 day, for at least 1 week, at least 2 weeks, at least 4 weeks, at least 5 week, or at least 6 weeks.

The amount of an IL-7Rα binding compound administered may vary during a treatment regimen.

Pharmaceutical compositions provided by the present disclosure may further comprise one or more pharmaceutically active compounds in addition to an IL-7Rα binding compound provided by the present disclosure. Such compounds may be provided, for example, to treat the cancer being treated with the IL-7Rα binding compound or to treat a disease, disorder, or condition other than the cancer being treated with the IL-7Rα binding compound, to treat a side-effect caused by administering the IL-7Rα binding compound, to augment the efficacy of the IL-7Rα binding compound, and/or to modulate the activity of the IL-7Rα binding compound.

An IL-7Rα binding compound provided by the present disclosure may be used in combination with at least one other therapeutic agent. An IL-7Rα binding compound may be administered to a patient together with another compound for treating cancer in the patient. The at least one other therapeutic agent can be a second, different IL-7Rα binding compound. An IL-7Rα binding compound and the at least one other therapeutic agent may act additively or, and in certain embodiments, synergistically with another IL-7Rα binding compound. The at least one additional therapeutic agent may be included in the same pharmaceutical composition or vehicle comprising the IL-7Rα binding compound or may be in a separate pharmaceutical composition or vehicle. Accordingly, methods provided by the present disclosure further include, in addition to administering an IL-7Rα binding compound, administering one or more therapeutic agents effective for treating cancer or a different disease, disorder or condition than cancer. Methods provided by the present disclosure include administration of an IL-7Rα binding compound and one or more other therapeutic agents provided that the combined administration does not inhibit the therapeutic efficacy of the IL-7Rα binding compound and/or does not produce adverse combination effects.

A pharmaceutical composition comprising an IL-7Rα binding compound may be administered concurrently with the administration of another therapeutic agent, which may be part of the same pharmaceutical composition as, or in a different pharmaceutical composition than that comprising an IL-7Rα binding compound. An IL-7Rα binding compound may be administered prior or subsequent to administration of another therapeutic agent. In certain combination therapies, the combination therapy may comprise alternating between administering an IL-7Rα binding compound and a composition comprising another therapeutic agent, e.g., to minimize adverse drug effects associated with a particular drug. When an IL-7Rα binding compound is administered concurrently with another therapeutic agent that potentially may produce an adverse drug effect including, for example, toxicity, the other therapeutic agent may be administered at a dose that falls below the threshold at which the adverse drug reaction is elicited.

A pharmaceutical composition comprising an IL-7Rα binding compound provided by the present disclosure may be administered with one or more substances, for example, to enhance, modulate and/or control release, bioavailability, therapeutic efficacy, therapeutic potency, and/or stability, of the IL-7Rα binding compound. For example, a pharmaceutical composition comprising an IL-7Rα binding compound can be co-administered with an active agent having pharmacological effects that enhance the therapeutic efficacy of the IL-7Rα binding compound.

An IL-7Rα binding compound, or a pharmaceutical composition thereof may be administered in conjunction with an agent known or believed to be effective in treating a disease such as cancer, an autoimmune disease or an inflammatory disease in a patient, such as the same disease being treated with the IL-7Rα binding compound.

An IL-7Rα binding compound, or a pharmaceutical composition thereof may be administered in conjunction with an agent known or believed to interfere with cell proliferation.

An IL-7Rα binding compound, or a pharmaceutical composition thereof may be administered in conjunction with an agent known or believed to interfere with cellular metabolism, to be an anti-metabolite, to interfere with RNA transcription, to interfere with RNA translation, to interfere with cellular protein synthesis, to interfere with synthesis of precursors for DNA synthesis and replication, to interfere with purine synthesis, to interfere with nucleoside synthesis, to interact with mTOR, to be an mTOR inhibitor, to interfere with cell cycle checkpoints.

An IL-7Rα binding compound or a pharmaceutical composition thereof may be administered in conjunction with a checkpoint inhibitor including a CTLA-4 inhibitor such as ipilimumab, a PD-1 inhibitor such as pembrolizumab and nivolumab, and/or a PD-LI inhibitor such as atezolizumab, avelumab, and durvalumab. An IL-7Rα binding compound or a pharmaceutical composition thereof may be administered in conjunction with an immunomodulator such as CD137/4-1BB, CD27, GIYR, and/or OC40.

An IL-7Rα binding compound or a pharmaceutical composition thereof may be administered in conjunction with an agent known or believed to be cytotoxic, to cause DNA damage, to cause cell cycle arrest, or to cause mitotic catastrophe.

An IL-7Rα binding compound or a pharmaceutical composition thereof may be administered in conjunction with an agent known or believed to modulate glutathione concentration, to modulate glutathione concentration within cells, to decrease glutathione concentration within cells, to reduce glutathione uptake into cells, to reduce glutathione synthesis, or to reduce glutathione synthesis within cells.

An IL-7Rα binding compound or a pharmaceutical composition thereof may be administered in conjunction with an agent known or believed to interfere with neovascularization, to reduce neovascularization, or to promote neovascularization.

An IL-7Rα binding compound or a pharmaceutical composition thereof may be administered in conjunction with an agent known or believed to interfere with hormone homeostasis, to interfere with hormone synthesis, to interfere with hormone receptor binding, or to interfere with hormone signal transduction.

An IL-7Rα binding compound or a pharmaceutical composition thereof may be administered in conjunction with an agent known or believed to interfere with growth factor homeostasis, to interfere with growth factor receptor expression, to interfere with growth factor binding to growth factor receptors, to interfere with growth factor receptor signal transduction, to interfere with the Hedgehog (Hh) signaling, to inhibit the Hedgehog pathway signaling, to inhibit ALK (anaplastic lymphoma kinase) pathway signaling, or to inhibit the non-homologous end joining (NHEJ) pathway.

An IL-7Rα binding compound or a pharmaceutical composition thereof may be administered in conjunction with one or more agents known or believed to be a VEGFR (vascular endothelial growth factor receptor) inhibitor, a RTK (receptor tyrosine kinase) inhibitor, a sodium channel current blocker, aFAK (focal adhesion kinase) inhibitor, a GLI (glioma-associated oncogene) inhibitor, a GLI1 inhibitor, a GLI2 inhibitor, a GLI3 inhibitor, a MAPK (mitogen-activated protein kinase) inhibitor, a MAPK/ERK pathway (also known as Ras-Raf-MEK-ERK pathways) inhibitor, a MEK1 inhibitor, a MEK2 inhibitor, a MEK5 inhibitor, a MEK5/ERK5 inhibitor, aRTA (renal tubular acidosis) inhibitor, a ALK (anaplastic lymphoma kinase) inhibitor, Aa LK kinase inhibitor, a nuclear translocation inhibitor, a PORCN (porcupine) inhibitor, a 5-ARI (5α-reductase inhibitor), topoisomerase inhibitor, a Ras (rat sarcoma) inhibitor, a K-ras inhibitor, a CERK (ceramide kinase) inhibitor, a PKB (protein kinase B, also known as AKT) inhibitor, a AKT1 inhibitor, EZH2 (enhancer of zeste homolog 2) inhibitor, a BET (bromodomain and extraterminal domain motif) inhibitor, a SYK (spleen tyrosine kinase) inhibitor, JAK (janus kinase) inhibitors, a SYK/JAK inhibitor, a IDO (indoleamine-pyrrole 2,3-dioxygenase) inhibitor, a IDO1 inhibitor, a RXR (retinoic×receptors) activating agent, a selective RXR activating agent, a p-glycoprotein inhibitor, a ERK inhibitor, a PI3K (phosphatidylinositol-4,5-bisphosphate 3-kinase) inhibitor, a BRD (bromodomain-containing protein) inhibitor, a BRD2 inhibitor, a BRD3 inhibitor, a BRD4 inhibitor, a BRDT (bromodomain testis-specific protein) inhibitor, a reverse transcriptase inhibitor, a NRT (nucleoside analog reverse-transcriptase) inhibitor, a PIM (proviral integrations of moloney virus) inhibitor, a EGFR (epidermal growth factor receptor) inhibitor, a photosensitizer, a radiosensitizer, a ROS (proto-oncogene, receptor tyrosine kinase) inhibitor, a ROS1 (proto-oncogene 1) inhibitor, a CK (casein kinase) inhibitor, a CK2 inhibitor, a Bcr-Abl (breakpoint cluster region-Abelson proto-oncogene) tyrosine-kinase inhibitor such as dasatinib, a microtubule stabilizing agent, a microtubule depolymerization/disassembly inhibitor, a DNA intercalator, an androgen receptor antagonist, a chemoprotective agents, a HDAC (histone deacetylase) inhibitor, a DPP (dipeptidyl peptidase) inhibitor, a DPP-4 inhibitor, BTK (Bruton's tyrosine kinase) inhibitor, a kinase inhibitor such as imatinib, a tyrosine kinase inhibitor such as nilotinib, a ARP (poly (ADP-ribose) polymerase) inhibitor, a CDK (cyclin-dependent kinase) inhibitor, a CDK4 inhibitor, a CDK6 inhibitor, a CDK4/6 inhibitor, a HIF1α (hypoxia-inducible factor 1-α) inhibitor, a DNA ligase inhibitor, a DNA ligase IV inhibitor, a NHEJ (non-homologous end joining) inhibitor, a DNA ligase IV, a NHEJ inhibitor and a RAF inhibitor, a TKI and a RAF inhibitor, a TKI and RAF inhibitor such as sorafenib, a PDT (photodynamic therapy) sensitizer, an ATR (ataxia telangiectasia- and Rad3-related protein kinase) inhibitor, or a combination of any of the foregoing.

An IL-7Rα binding compound or a pharmaceutical composition thereof may be administered in conjunction with one or more chemotherapeutic agents, such as, for example, a VEGFR inhibitor such as fruquintinib, motesanib/AMG-706, vatalanib; a RTK inhibitor such as ponatinib; a sodium channel blocker such as GS967; a FAK inhibitor such as TAE226; a GLI1 and GLI2 inhibitor such as GANT61, a MEK inhibitor such as binimetinib; a RTA inhibitor such as linifanib; an ALK inhibitor such as brigstinib; bromopyruvic acid; a DNA alkylating agent such as thiotepa; nuclear translocations factors such as JSH-23; a PORCn inhibitor such as Wnt-059; a 5α-reductase inhibitor such as dutasteride; a topoisomerase inhibitor such as carubicin; a RAS inhibitor such as Kobe0065; a CerK inhibitor such as NVP-231; an AKT inhibitor such as uprosertib; a EZH2 inhibitor such as GSK-503; a BET bromodomain inhibitor such as OTX015; a MEK5/ERK5 inhibitor such as BIX02189; a Syl/JAK inhibitor such as cerdulatinib; an IDO1 inhibitor such as NLG919; a retinoic×receptor activating agent such as bexsrotene; a PGP inhibitor such as acotiamide or actotiamide HCl; an Erk inhibitor such SCH772984; a PI3K inhibitor such as gedatolisib; a JAK inhibitor such as ruxolitinib; an AKT inhibitor such as afuresertib or afuresertib HCl; an ALK1 inhibitor such as ceritinib; an HDAC inhibitor such as abexinostat; a DPP inhibitor such as oamarigliptin; an EGFR inhibitor such as gefittinib; an EZH2 inhibitor such as GSK126; a BTK inhibitor such as ibrutinib; a kinase inhibitor such as imatinin HCl; an IDO inhibitor such as INCB024360; a DNA crosslinker such as mitomycin C; a tyrosine kinase inhibitor such as nilotinib, a PARP inhibitor such as olaparib; a tubulin stabilization promoter such as paclitaxel; a CDK4/6 inhibitor such as palbociclib; a RTK inhibitor such as sunitinib; a PDT sensitizer such as tslsporfin; a p-glycoprotein inhibitor such as tariquidar; an ATR inhibitor such as VE-822; an HDAC inhibitor such as PCI-24781; a DPP inhibitor such as omarigliptin; an EGFR inhibitor such as gefinib; an EZH2 inhibitor such as GSK126; a BTK inhibitor such as irbrutinib; an IDO inhibitor such as INCB024360; or a combination of any of the foregoing.

For example, an IL-7Rα binding compound or a pharmaceutical composition thereof may be administered in conjunction with another chemotherapeutic agent, such as, for example, N-acetyl cysteine (NAC), adriamycin, alemtuzumab, amifostine, arsenic trioxide, ascorbic acid, bendamustine, bevacizumab, bortezomib, busulfan, buthionine sulfoxime, carfilzomib, carmustine, clofarabine, cyclophosphamide, cyclosporine, cytarabine, dasatinib, datinomycin, defibrotide, dexamethasone, docetaxel, doxorubicin, etoposide, filgrastim, floxuridine, fludarabine, gemcitabine, interferon alpha, ipilimumab, lenalidomide, leucovorin, melphalan, mycofenolate mofetil, paclitaxel, palifermin, panobinostat, pegfilrastim, prednisolone, prednisone, revlimid, rituximab, sirolimus, sodium 2-mercaptoethane sulfonate (MESNA), sodium thiosulfate, tacrolimus, temozolomide, thalidomide, thioguanine, thiotepa, topotecan, velcade, or a combination of any of the foregoing.

An IL-7Rα binding compound or a pharmaceutical compositions thereof can be used in combination therapy with other chemotherapeutic agents including one or more antimetabolites such as folic acid analogs; pyrimidine analogs such as fluorouracil, floxuridine, and cytosine arabinoside; purine analogs such as mercaptopurine, thiogunaine, and pentostatin; natural products such as vinblastine, vincristine, etoposide, tertiposide, dactinomycin, daunorubicin, doxurubicin, bleomycin, mithamycin, mitomycin C, L-asparaginase, and interferon alpha; platinum coordination complexes such as cis-platinum, and carboplatin; mitoxantrone; hydroxyurea; procarbazine; hormones and antagonists such as prednisone, hydroxyprogesterone caproate, medroxyprogesterone acetate, megestrol acetate, diethylstilbestrol, ethinyl estradiol, tamoxifen, testosterone propionate, fluoxymesterone, flutamide, and leuprolide, anti-angiogenesis agents or inhibitors such as angiostatin, retinoic acids, paclitaxel, estradiol derivatives, and thiazolopyrimidine derivatives; apoptosis prevention agents; triptolide; colchicine; luliconazole; and radiation therapy.

An IL-7Rα binding compound or a pharmaceutical composition thereof may be co-administered with a compound that inhibits DNA repair such as, for example, O6-benzylguanine (O6-BG).

An IL-7Rα binding compound or a pharmaceutical composition thereof may be administered in conjunction with one or more chemotherapeutic agents, such as, for example, abarelix, abiraterone, abiraterone acetate, n-acetyl cysteine, aclarubicin hydrochloride, adriamycin, adenine, afatinib, afatinib dimaleate, alemtuzumab, alendronate sodium, alitretinoin, allopurinol sodium, altretamine, amifostine, aminoglutethimide, aminolevulinic acid, amrubicin, amsacrine, anastrozole, angiostatin, apremilast, aprepitant, arsenic trioxide, ascorbic acid, l-asparaginase, azacitidine, azathioprine sodium, bazedoxifene (serm), belinostat, bendamustine hcl, O6-benzylguanine, bevacizumab, bexarotene, bicalutamide, biricodar, bleomycin sulfate, bortezomib, bosutinib, brivudine, buserelin, busulfan, buthionine sulfoxime, cabazitaxel, cabozantinib, capecitabine, carboplatin, carboquone, carfilzomib, carmofur, carmustine, ceritinib, chlorambucil, cisplatin, cladribine, clodronate disodium, clofarabine, crizotinib, cyclophosphamide, cyclosporine, cytarabine, cytosine arabinoside, dabrafenib, dacarbazine, dactinomycin, dasatinib, datinomycin, daunorubicin, decitabine, defribrotide, degarelix acetate, dexamethasone, dexrazoxane hydrochloride, diaziquone, diethyl stilbestrol, docetaxel, doxifluridine, doxorubicin hydrochloride, doxorubicin free base, dromostanolone propionate, dutasteride, eltrombopag, enzalutamide, epirubicin hydrochloride, eribulin mesylate, erlotinib hydrochloride, estramustine phosphate sodium, ethinyl estradiol, etoposide phosphate, etoposide, everolimus, exemestane, fentanyl, filgrastim, fingolimod, floxuridine, fludarabine phosphate, fluorouracil, fluoxymesterone, flutamide, formestane, formylmelphalan, fosaprepitant, fotemustine, fulvestrant, gefitinib, gemcitabine hydrochloride, gemcitabine free base, glutathione, glyciphosphoramide, glyfosfin, goserelin acetate, granisetron hydrochloride, heptaplatin, hexyl 5-aminolevulinate, histrelin acetate, hydroxyprogesterone caproate, hydroxyurea, ibandronate sodium, ibrutinib, icotinib, idarubicin HCl, idelalisib, idoxuridine, ifosfamide, interferon alpha, imatinib mesylate, imiquimod, ingenol mebutate, ipilimumab, irinotecan hydrochloride, ixabepilone, lanreotide acetate, lapatinib free base, lapatinib ditosylate, lasofoxifene, lenalidomide, letrozole, leucovorin calcium, leuprolide acetate, levamisole hydrochloride, levoleucovorin calcium, iobenguane, lobaplatin, lomustine, maropitant, masoprocol, mechlorethamine hydrochloride, megestrol acetate, medroxyprogesterone acetate, melphalan hydrochloride, mercaptopurine, mercaptoethane sulfonate sodium, methotrexate, methoxsalen, methyl aminolevulinate, methylene blue, methylisoindigotin, mifamurtide, miltefosine, miriplatin, mithamycin, mitobronitol, mitomycin C, mitotane, mitoxantrone hydrochloride, mycophenolate mofetil, nabiximols, nafarelin, nandrolone, nedaplatin, nelarabine, netupitant, nilotinib, nilutamide, nimustine, nintedanib, nocodazole, octreotide, olaparib, omacetaxine mepesuccinate, ondansetron hydrochloride, oxaliplatin, paclitaxel, palbociclib, palifermin, palonosetron hydrochloride, pamidronate disodium, panobinostat, pasireotide, pazopanib hydrochloride, pegfilrastim, pemetrexed disodium, pentostatin, peplomycin, pipobroman, pirarubicin, plerixafor, plicamycin, pomalidomide, ponatinib, porfimer sodium, porfiromycin, pralatrexate, prednimustine, prednisolone, prednisone, procarbazine hydrochloride, quinagolide hydrochloride, raloxifene, raltitrexed, radotinib, ranimustine, retinoic acids, revlimide, rituxinab, romidepsin, ruxolitinib, ruxolitinib phosphate, semustine, sirolimus, sodium thiosulfate, sorafenib free base, sorafenib tosylate, streptozocin, sufentanil, sunitinib, tacrolimus, talaporfin sodium, tamibarotene, tamoxifen citrate, tapentadol, temoporfin, temozolomide, temsirolimus, teniposide, teriflunomide, tertiposide, testolactone, testosterone propionate, thalidomide, thioguanine, thiotepa, thymalfasin, toceranib phosphate, topotecan hydrochloride, toremifene citrate, trabectedin, trametinib, tretinoin, trilostane, triptorelin, tropisetron, uramustine, valrubicin, vandetanib, vedotin, vemurafenib, verteporfin, vinblastine, vincristine sulfate, vincristine free base, vindesine, vinorelbine tartrate, vorinostat, and zoledronic acid.

An IL-7Rα binding compound or a pharmaceutical composition thereof may be administered in conjunction with one or more chemotherapeutic agents such as, for example, abemaciclib, abiraterone acetate, ABVD, ABVE, ABVE-PC, AC, acalabrutinib, AC-T, ADE, ado-trastuzumab emtansine, afatinib dimaleate, aldesleukin, alectinib, alemtuzumab, alpelisib, amifostine, aminolevulinic acid hydrochloride, anastrozole, apalutamide, aprepitant, arsenic trioxide, asparaginase Erwinia chrysanthemi, atezolizumab, avelumab, axicabtagene ciloleucel, axitinib, azacitidine, BEACOPP, belinostat, bendamustine hydrochloride, BEP, bevacizumab, bexarotene, bicalutamide, binimetinib, bleomycin sulfate, blinatumomab, bortezomib, bosutinib, brentuximab vedotin, brigatinib, BuMel, busulfan, cabazitaxel, cabozantinib-s-malate, CAF, calaspargase pegol-mknl, capecitabine, caplacizumab-yhdp, CAPOX, carboplatin, carboplatin-taxol, carfilzomib, carmustine, carmustine implant, CEM, cemiplimab-rwlc, ceritinib, cetuximab, CEV, chlorambucil, chlorambucil-prednisone, CHOP, cisplatin, cladribine, clofarabine, CMF, cobimetinib, copanlisib hydrochloride, COPDAC, COPP, COPP-ABV, crizotinib, CVP, cyclophosphamide, cytarabine, cytarabine liposome, dabrafenib mesylate, dacarbazine, dacomitinib, dactinomycin, daratumumab, darbepoetin α, dasatinib, daunorubicin hydrochloride, daunorubicin hydrochloride and cytarabine liposome, decitabine, defibrotide sodium, degarelix, denileukin diftitox, denosumab, dexamethasone, dexrazoxane hydrochloride, dinutuximab, docetaxel, doxorubicin hydrochloride, doxorubicin hydrochloride liposome, durvalumab, duvelisib, elotuzumab, eltrombopag olamine, emapalumab-lzsg, enasidenib mesylate, encorafenib, enzalutamide, epirubicin hydrochloride, EPOCH, epoetin α, erdafitinib, eribulin mesylate, erlotinib hydrochloride, etoposide, etoposide phosphate, everolimus, exemestane, fec, filgrastim, fludarabine phosphate, fluorouracil injection, fluorouracil—topical, flutamide, folfiri, folfiri-bevacizumab, folfiri-cetuximab, folfirinox, folfox, fostamatinib disodium, FU-LV, fulvestrant, gefitinib, gemcitabine hydrochloride, gemcitabine-cisplatin, gemcitabine-oxaliplatin, gemtuzumab ozogamicin, gilteritinib fumarate, glasdegib maleate, glucarpidase, goserelin acetate, granisetron, HPV bivalent vaccine, HPV bivalent vaccine, recombinant HPV nonavalent vaccine, HPV nonavalent vaccine, recombinant, HPV quadrivalent vaccine, HPV uadrivalent vaccine recombinant, hydroxyurea, hyper-CVAD, ibritumomab tiuxetan, ibrutinib, ICE, idarubicin hydrochloride, idelalisib, ifosfamide, imatinib mesylate, imiquimod, inotuzumab ozogamicin, interferon α-2b recombinant, iobenguane $^{131}$I, ipilimumab, irinotecan hydrochloride, irinotecan hydrochloride liposome, ivosidenib, ixabepilone, ixazomib citrate, JEB, lanreotide acetate, lapatinib ditosylate, larotrectinib sulfate, lenalidomide, lenvatinib mesylate, letrozole, leucovorin calcium, leuprolide acetate, lomustine, lorlatinib, lutetium Lu 177-dotatate, mechlorethamine hydrochloride, megestrol acetate, melphalan, melphalan hydrochloride, mercaptopurine, mesna, methotrexate, methylnaltrexone bromide, midostaurin, mitomycin c, mitoxantrone hydrochloride, mogamulizumab-kpkc, moxetumomab pasudotox-tdfk, MVAC, necitumumab, nelarabine, neratinib maleate, netupitant and palonosetron hydrochloride, nilotinib, nilutamide, niraparib tosylate monohydrate, nivolumab, obinutuzumab, OEPA, ofatumumab, OFF, olaparib, olaratumab, omacetaxine mepesuccinate, ondansetron hydrochloride, OPPA, osimertinib mesylate, oxaliplatin, paclitaxel, paclitaxel albumin-stabilized nanoparticle formulation, PAD, palbociclib, palifermin, palonosetron hydrochloride, palonosetron hydrochloride and netupitant, pamidronate disodium, panitumumab, panobinostat, pazopanib hydrochloride, PCV, PEB, pegaspargase, pegfilgrastim, peginterferon α-2b, pembrolizumab, pemetrexed disodium, pertuzumab, plerixafor, polatuzumab vedotin-piiq, pomalidomide, ponatinib hydrochloride, pralatrexate, prednisone, procarbazine hydrochloride, propranolol hydrochloride, radium 223 dichloride, raloxifene hydrochloride, ramucirumab, rasburicase, ravulizumab-cwvz, R-CHOP, R-CVP, recombinant HPV bivalent vaccine, recombinant HPV nonavalent vaccine, recombinant HPV quadrivalent vaccine, recombinant interferon α-2b, regorafenib, R-EPOCH, ribociclib, R-ICE, rituximab, rituximab and hyaluronidase human, rolapitant hydrochloride, romidepsin, romiplostim, rucaparib camsylate, ruxolitinib phosphate, siltuximab, sipuleucel-t, sonidegib, sorafenib tosylate, STANFORD V, sunitinib malate, TAC, tagraxofusp-erzs, talazoparib tosylate, talc, talimogene laherparepvec, tamoxifen citrate, temozolomide, temsirolimus, thalidomide, thioguanine, thiotepa, tisagenlecleucel, tocilizumab, topotecan hydrochloride, toremifene, TPF, trabectedin, trametinib, trastuzumab, trastuzumab and hyaluronidase-oysk, trifluridine and tipiracil hydrochloride, uridine triacetate, VAC, Valrubicin, VAMP, vandetanib, VeIP, vemurafenib, venetoclax, vinblastine sulfate, vincristine sulfate liposome, vinorelbine tartrate, vip, vismodegib, vorinostat, XELIRI, XELOX, Ziv-aflibercept, zoledronic acid, and combinations of any of the foregoing.

The efficacy of administering an IL-7Rα binding compound or a pharmaceutical composition thereof for treating cancer may be assessed using in vitro and animal studies and in clinical trials.

The suitability of an IL-7Rα binding compound or a pharmaceutical composition thereof in treating cancer may be determined by methods described in the art.

An IL-7Rα binding compound or a pharmaceutical composition thereof can be useful in treating inflammatory diseases.

An IL-7Rα binding compound or a pharmaceutical composition thereof may be administered to a patient in need of such treatment to treat an inflammatory disease.

Examples of inflammatory diseases include allergy, Alzheimer's disease, anemia, ankylosing spondylitis, arthritis, atherosclerosis, asthma, autism, arthritis, carpal tunnel syndrome, celiac disease, colitis, Crohn's disease, congestive heart failure, dermatitis, diabetes, diverticulitis, eczema, fibromyalgia, fibrosis, gall bladder disease gastroesophageal reflux disease, Hashimoto's thyroiditis, heart attack, hepatitis, irritable bowel syndrome, kidney failure, lupus, multiple sclerosis, nephritis, neuropathy, pancreatitis, Parkinson's disease, psoriasis, polymyalgia rheumatica, rheumatoid arthritis, scleroderma, stroke, surgical complications, and ulcerative colitis.

An IL-7Rα binding compound or a pharmaceutical composition thereof can be useful in treating autoimmune diseases. Autoimmune diseases can be defined as human diseases in which the immune system attacks its own proteins, cells, and/or tissues. A comprehensive listing and review of autoimmune diseases can be found, for example, in *The Autoimmune Diseases*, Rose and Mackay, 2014, Academic Press.

An IL-7Rα binding compound or a pharmaceutical composition thereof may be administered to a patient in need of such treatment to treat an autoimmune disease.

Examples of autoimmune diseases include Addison's disease, agammaglobulinemia, alopecia areata, amyloidosis, ankylosing spondylitis, anti-GBM/anti-TBN nephritis, antiphospholipid syndrome, autoimmune angioedema, autoimmune dysautonomia, autoimmune encephalomyelitis, autoimmune hepatitis, autoimmune inner ear disease, autoimmune myocarditis, autoimmune pancreatitis, autoimmune retinopathy, autoimmune urticaria, axonal and neuronal neuropathy, Balo disease, Behcet's disease, benign mucosal pemphigoid, bullous pemphigoid, Castleman disease, celiac disease, Chagas disease, chronic inflammatory demyelinating polyneuropathy, chronic recurrent multifocal osteomyelitis, Churg-Strauss, cicatricial pemphigoid, Cogan' syndrome, cold agglutinin disease, congenital heart block, Coxcackie myocarditits, CREST syndrome, Crohn's disease, dermatitis herpetiformis, dermatomyositis, Devic's disease, discoid lupus, Dressler's syndrome, endometriosis, eosinophilic esophagitis, eosinophilic fasciitis, erythema nodosum, essential mixed cryoglobulinemia, Evans syndrome, fibromyalgia, fibrosing alveolitis, giant cell arteritis, giant cell myocarditis, glomerulonephritis, Goodpasture's syndrome, granulomatosis with polyangiitis, Graves' disease, Gullain-Barre syndrome, Hashimoto's thyroiditis, hemolytic anemia, Henoch-Schonlein purpura, herpes gestationis or pemphigoid gestationis, hypogammaglobulinemia, IgA nephropathy, IgG4-related sclerosing disease, immune thrombocytopenic purpura, inclusion body myositis, interstitial cystitis, juvenile arthritis, juvenile diabetes, juvenile myositis, Kawasaki disease, Lambert-Eaton syndrome, leukocytoclastic vasculitis, lichen planus, lichen sclerosis, ligneous conjunctivitis, linear IgA disease, lupus, Lyme disease chronic, Meniere's diseases, microscopic polyangiitis, mixed connective tissue disease, Mooren's ulcer, Mucha-Habermann disease, multiple sclerosis, myasthenia gravis, myositis, narcolepsy, neuromyelitis, optica, neutropenia, ocular cicatricial pemphigoid, optic neuritis, palindromic rheumatism, PANDAS, paraneoplastic cerebellar degeneration, paroxysmal nocturnal hemoglobinuria, Parry Romberg syndrome, pars planitis, Parsonnage-Turner syndrome, pemphigus, peripheral neuropathy, perivenous encephalomyelitis, pernicious anemia, POEMS syndrome, polyarteritis nodosa, polyglandular syndromes, polymyalgia rheumatica, polymyositis, postmyocardial infarction syndrome, postpericardiotomy syndrome, primary biliary cirrhosis, primary sclerosing cholangitis, progesterone dermatitis, psoriasis, psoriatic arthritis, pure red cell aplasia, pyoderma gangrenosum, Raynaud's phenomenon, reactive arthritis, reflex sympathetic dystrophy, relapsing polychondritis, restless legs syndrome, retroperitoneal fibrosis, rheumatic fever, rheumatoid arthritis, sarcoidosis, Schmidt syndrome, scleritis, scleroderma, Sjogren's syndrome, sperm and testicular autoimmunity, stiff person syndrome, subacute bacterial endocarditis, Susac's syndrome, sympathetic ophthalmia, Takayasu's arteritis, temporal arteritis, thrombocytopenic purpura, Tolosa-Hunt syndrome, transverse myelitis, type 1 diabetes, ulcerative colitis, undifferentiated connective tissue disease, uveitis, vaculitis, vitiligo, and Wegener's granulomatosis.

An IL-7Rα binding compound or a pharmaceutical composition thereof can be used to treat autoimmune disorders such as, for example, lupus, graft-versus-host disease, hepatitis C-induced vasculitis, Type I diabetes, multiple sclerosis, spontaneous loss of pregnancy, atopic diseases, and inflammatory bowel diseases.

An IL-7Rα binding compound can be administered with one or more additional therapeutic agents for treating an autoimmune disease. An IL-7Rα binding compound or a pharmaceutical composition thereof may be administered in conjunction with one or more immunosuppressants including, for example, corticosteroids such as prednisone, budesonide, and prednisolone; Janus kinase inhibitors such as tofacitinib; calcineurin inhibitors such as cyclosporine and tacrolimus; mTOR inhibitors such as sirolimus and everolimus; IMDH inhibitors such as azathioprine, leflunomide, and mycophenolate; biologics such as abatacept adalimumab, anakinra, certolizumab, etanercept, golimumab, infliximab, ixekizumab, natalizumab, rituximab, secukinumab, tocilizumab, ustekinumab, and vedolizumab; and monoclonal antibodies such as basiliximab and daclizumab.

An IL-7Rα binding compound or a pharmaceutical composition thereof may be administered to a patient to treat a disease associated with the activation, proliferation, metabolism, and/or differentiation of T-cells.

An IL-7Rα binding compound or a pharmaceutical composition thereof may be administered to a patient to treat an organ transplant.

An IL-7Rα binding compound or a pharmaceutical composition thereof may be administered in conjunction with an agent known or believed to interfere with proliferation, to interfere with mitosis, to interfere with DNA replication, or to interfere with DNA repair.

An IL-7Rαγc binding compound or a pharmaceutical composition thereof may be administered to a patient to treat an immune deficiency disease.

Example of primary immune deficiency disease include autoimmune lymphoproliferative syndrome, autoimmune polyglandular syndrome type 1, BENTA disease, caspase eight deficiency state, CARD9 deficiency, chronic granulomatous disease, common variable immunodeficiency, congenital neutropenia syndromes, CTLA4 deficiency, DOCK8 deficiency, GATA2 deficiency, glycosylation disorders, hyper-immunoglobulin E syndromes, hyper-immunoglobulin M syndromes, interferon γ, interleukin 12 and interleukin 23 deficiency, leukocyte adhesion deficiency, LRBA deficiency, PI2 kinase disease, PLCG2-associated antibody deficiency and immune dysregulation, severe combined immunodeficiency, STAT3 dominant-negative disease, STAT3 gain-of-function disease, warts, hypogammaglobulinemia, infections, and myelokathexis syndrome, Wiskott-Aldrich syndrome, X-linked agammaglobulinemia, X-linked lymphoproliferative disease, and XMEN disease.

Secondary immune deficiency disease occurs when the immune system is compromised to an environmental factor such as infection, chemotherapy, severe burns, or malnutrition. Example of secondary immune deficiency diseases include newborn immunodeficiencies such as immature lymphoid organs, absent memory immunity, low maternal IgG levels, decreased neutrophil storage pool, decreased neutrophil function, and decreased natural killer cell activity; advanced age related immunodeficiencies such as decreased antigen-specific cellular immunity, T-cell oligoconality, and restricted B-cell repertoire; malnutrition related immunodeficiencies such as decreased cellular immune response and weekend mucosal barriers; diabetes mellitus related immunodeficiencies such as decreased mitogen-induced lymphoproliferation, defective phagocytosis, and decreased chemotaxis; chronic uremia related immunodeficiencies such as decreased cellular immune response, decreased generation of memory antibody responses, and decreased chemotaxis; genetic syndromes such as defective phagocytosis, defective chemotaxis, and variable defects of antigen-specific immune responses; and anti-inflammatory, immunomodulatory, and immuno-suppressive drug therapy related immune deficiencies such as lymphopenia, decreased cellular immune response and anergy, decreased proinflammatory cytokines, decreased phagocytosis, decreased chemotaxis, neutropenia, and weakened mucosal barriers; environmental conditions such as increased lymphocyte apoptosis, increased secretion of tolerogenic cytokines, cytopenia, decreased cellular immunity and anergy, and stress-induced nonspecific immune activation; and infectious diseases such as T-cell lymphopenia, decreased cellular immune response and anergy, and defective antigen-specific antibody responses.

An IL-7Rαγc binding compound or a pharmaceutical composition thereof may be administered to a patient to increase the immune response in immuno-compromised patients.

An IL-7Rαγc binding compound or a pharmaceutical composition thereof may be administered to a patient to increase the immune response in elderly patients.

An IL-7Rαγc binding compound or a pharmaceutical composition thereof may be administered to a patient to treat an infectious disease including viral diseases such as COVID-19.

Examples of infectious diseases include *Acinetobacter* infections, actinomycosis, African sleeping sickness (African trypanosomiasis), AIDS (acquired immunodeficiency syndrome), amoebiasis, anaplasmosis, angiostrongyliasis, anisakiasis, anthrax, *Arcanobacterium haemolyticum* infection, Argentine hemorrhagic fever, ascariasis, aspergillosis, astrovirus infection, babesiosis, *Bacillus cereus* infection, bacterial meningitis, bacterial pneumonia, bacterial vaginosis, *Bacteroides* infection, balantidiasis, bartonellosis, *Baylisascaris* infection, Bejel, syphilis, yaws, BK virus infection, black piedra, blastocystosis, blastomycosis, Bolivian hemorrhagic fever, botulism (and Infant botulism), Brazilian hemorrhagic fever, brucellosis, bubonic plague, *Burkholderia* infection, buruli ulcer, calicivirus infection (Norovirus and Sapovirus), campylobacteriosis, candidiasis (Moniliasis; Thrush), capillariasis, carrion's disease, cat-scratch disease, cellulitis, Chagas disease (American trypanosomiasis), chancroid, chickenpox, chikungunya, chlamydia, *Chlamydophila pneumoniae* infection (Taiwan acute respiratory agent or TWAR), cholera, chromoblastomycosis, Chytridiomycosis, clonorchiasis, *Clostridium difficile* colitis, coccidioidomycosis, Colorado tick fever (CTF), common cold (acute viral rhinopharyngitis; Acute coryza, Coronavirus disease 2019 (COVID-19), Creutzfeldt-Jakob disease (CJD), Crimean-Congo hemorrhagic fever (CCHF), cryptococcosis, cryptosporidiosis, cutaneous larva migrans (CLM), cyclosporiasis, cysticercosis, cytomegalovirus infection, Dengue fever, desmodesmus infection, dientamoebiasis, diphtheria, diphyllobothriasis, dracunculiasis, Ebola hemorrhagic fever, echinococcosis, Ehrlichiosis, enterobiasis (pinworm infection), *Enterococcus* infection, enterovirus infection, epidemic typhus, Epstein-Barr virus infectious mononucleosis (Mono), erythema infectiosum (Fifth disease), fxanthem subitum (Sixth disease), fasciolosis, fasciolopsiasis, fatal familial insomnia (FFI), filariasis, food poisoning by *Clostridium perfringens*, free-living amebic infection, *Fusobacterium* infection, gas gangrene (Clostridial myonecrosis), geotrichosis, Gerstmann-Sträussler-Scheinker syndrome (GSS), giardiasis, glanders, gnathostomiasis, gonorrhea, granuloma inguinale (Donovanosis), Group A streptococcal infection, Group B streptococcal infection, *Haemophilus influenzae* infection, hand, foot and mouth disease (HFMD), Hantavirus Pulmonary Syndrome (HPS), Heartland virus disease, *Helicobacter pylori* infection, hemolytic-uremic syndrome (HUS), hemorrhagic fever with renal syndrome (HFRS), Hendra virus infection, Hepatitis A, Hepatitis B, Hepatitis C, Hepatitis D, Hepatitis E, Herpes simplex, histoplasmosis, hookworm infection, human bocavirus infection, human ewingii ehrlichiosis, human granulocytic anaplasmosis (HGA), human metapneumovirus infection, human monocytic ehrlichiosis, human papillomavirus (HPV) infection, human parainfluenza virus infection, hymenolepiasis, influenza (flu), isosporiasis, Kawasaki disease, keratitis, *Kingella kingae* infection, Kuru, Lassa fever, Legionellosis (Legionnaires' disease), leishmaniasis, leprosy, leptospirosis, listeriosis, Lyme disease (Lyme borreliosis), lymphatic filariasis (elephantiasis), lymphocytic choriomeningitis, malaria, Marburg hemorrhagic fever (MHF), measles, melioidosis (Whitmore's disease), meningitis, meningococcal disease, metagonimiasis, microsporidiosis, Middle East respiratory syndrome (MERS), molluscum contagiosum (MC), monkeypox, mumps, murine typhus (Endemic typhus), mycetoma, *Mycoplasma genitalium* infection, *Mycoplasma pneumonia*, myiasis, neonatal conjunctivitis (Ophthalmia neonatorum), Nipah virus infection, nocardiosis, Norovirus (children and babies), onchocerciasis (River blindness), opisthorchiasis, paracoccidioidomycosis (South American blastomycosis), paragonimiasis, pasteurellosis, pediculosis capitis (Head lice), pediculosis corporis (Body lice), pediculosis pubis (pubic lice, crab lice), pelvic inflammatory disease (PID), pertussis (whooping cough), plague, pneumococcal infection, pneumocystis pneumonia (PCP), pneumonia, poliomyelitis, Pontiac fever, *Prevotella* infection, primary amoebic meningoencephalitis (PAM), progressive multifocal leukoencephalopathy, psittacosis, Q fever, rabies, relapsing fever, respiratory syncytial virus infection, rhinosporidiosis, rhinovirus infection, rickettsial infection, rickettsialpox, Rift Valley fever (RVF), Rocky Mountain spotted fever (RMSF), rotavirus infection, rubella, salmonellosis, SARS (severe acute respiratory syndrome), scabies, scarlet fever, schistosomiasis, sepsis, shigellosis (bacillary dysentery), shingles (Herpes zoster), smallpox (variola), sporotrichosis, staphylococcal food poisoning, staphylococcal infection, strongyloidiasis, subacute sclerosing panencephalitis, taeniasis, tetanus (lockjaw), tinea barbae (barber's itch), tinea capitis (ringworm of the scalp), tinea corporis (ringworm of the body), tinea cruris (Jock itch), tinea manum (ringworm of the hand), tinea nigra, tinea pedis (athlete's foot), tinea unguium (onychomycosis), tinea versicolor (*Pityriasis versicolor*), toxocariasis (ocular larva migrans (OLM), toxocariasis (visceral larva migrans (VLM), toxoplasmosis, trachoma, trichinosis, trichomoniasis, trichuriasis (whipworm infection), tuberculosis, tularemia, typhoid fever, typhus fever, *Ureaplasma urealyticum* infection, valley fever, Venezuelan equine encephalitis, Venezuelan hemorrhagic fever, *Vibrio parahaemolyticus* enteritis, *Vibrio vulnificus* infection, viral pneumonia, West Nile fever, white piedra (tinea blanca), yellow fever, *Yersinia pseudotuberculosis* infection, yersiniosis, zeaspora, Zika fever, and zygomycosis An IL-7Rα binding compound provided by the present disclosure can be used, either alone or in combination, to treat diseases including acute myeloid leukemia, B-cell lymphoma, chronic myelogenous leukemia, depression, gingival recession, hepatitis C, HIV infections, human papillomavirus, idiopathic CD4 lymphopenia, immunodeficiency secondary to organ transplantation, lipodystrophy, Kaposi sarcoma lymphoma, lymphopenia, mantle cell lymphoma, multiple sclerosis, myelodysplastic syndrome, non-Hodgkin lymphoma, recurrent adult diffuse large cell lymphoma, recurrent follicular lymphoma, rheumatoid arthritis, sepsis, and Type 2 diabetes.

An IL-7Rα binding compound provided by the present disclosure can be used to treat cancers such as metastatic breast cancer, breast cancer, colon cancer, bladder cancer, metastatic prostate cancer, stage IV prostate cancer, castration-resistant prostate carcinoma, neuroblastoma, melanoma, kidney cancer, myeloproliferative neoplasm, sarcoma, and neurodermal tumors.

An IL-7Rα binding compound provided by the present disclosure can be used in combination with temozolomide to great glioblastoma, with atezolizumab to treat skin cancers such as MCC, C5CC and melanoma, with pembrolizumab to treat triple negative breast cancer, and in combination with CAR-T therapy to treat pediatric acute lymphoblastic leukemia.

An IL-7Rα binding compound provided by the present disclosure can be used as a vaccine adjuvant.

An IL-7Rα binding compound provided by the present disclosure and pharmaceutical compositions of any of the foregoing may be administered to a patient to treat a disease associated with the activation, proliferation, metabolism, and/or differentiation of T-cells.

An IL-7Rα binding compound provided by the present disclosure and pharmaceutical compositions of any of the foregoing may be administered to a patient to treat an organ transplant.

An IL-7Rα binding compound provided by the present disclosure and pharmaceutical compositions of any of the foregoing may be administered to a patient together with another compound for treating an inflammatory disease or an autoimmune disease in the subject. The at least one other therapeutic agent may be an IL-7Rα binding compound provided by the present disclosure. An IL-7Rα binding compound and the at least one other therapeutic agent may act additively or synergistically. The at least one additional therapeutic agent may be included in the same pharmaceutical composition or vehicle comprising the IL-7Rα binding compound or may be in a separate pharmaceutical composition or vehicle. Accordingly, methods provided by the present disclosure further include, in addition to administering an IL-7Rα binding compound, administering one or more therapeutic agents effective for treating an inflammatory disease or an autoimmune disease or a different disease, disorder or condition than an inflammatory disease or an autoimmune disease. Methods provided by the present disclosure include administration of an IL-7Rα binding compound and one or more other therapeutic agents provided that the combined administration does not inhibit the therapeutic efficacy of an IL-7Rα binding compound and/or does not produce adverse combination effects.

Pharmaceutical compositions comprising an IL-7Rα binding compound be administered concurrently with the administration of another therapeutic agent, which may be part of the same pharmaceutical composition as, or in a different pharmaceutical composition than that comprising an IL-7Rα binding compound. An IL-7Rα binding compound may be administered prior or subsequent to administration of another therapeutic agent. In combination therapy, the combination therapy may comprise alternating between administering an IL-7Rα binding compound and a composition comprising another therapeutic agent, e.g., to minimize adverse drug effects associated with a particular drug. When an IL-7Rα binding compound is administered concurrently with another therapeutic agent that potentially may produce an adverse drug effect including, for example, toxicity, the other therapeutic agent may be administered at a dose that falls below the threshold at which the adverse drug reaction is elicited.

Pharmaceutical compositions comprising an IL-7Rα binding compound may be administered with one or more substances to enhance, modulate and/or control release, bioavailability, therapeutic efficacy, therapeutic potency, stability, and the like of a compound of an IL-7Rα binding compound. For example, to enhance the therapeutic efficacy of an IL-7Rα binding compound, metabolite thereof, or a pharmaceutical composition of any of the foregoing may be co-administered with one or more active agents to increase the absorption or diffusion of the IL-7Rα binding compound from the gastrointestinal tract to the systemic circulation, or to inhibit degradation of the IL-7Rα binding compound in the blood of a subject. A pharmaceutical composition comprising an IL-7Rα binding compound may be co-administered with an active agent having pharmacological effects that enhance the therapeutic efficacy of the IL-7Rα binding compound.

An IL-7Rα binding compound, or a pharmaceutical composition comprising any of the foregoing may be administered in conjunction with an agent known or believed to be effective in treating an inflammatory disease or an autoimmune disease in a patient.

An IL-7Rα binding compound, or a pharmaceutical composition comprising any of the foregoing may be administered in conjunction with an agent known or believed to interfere with proliferation. An IL-7Rα binding compound, or a pharmaceutical composition comprising any of the foregoing may be administered in conjunction with an agent known or believed to interfere with mitosis. An IL-7Rα binding compound, or a pharmaceutical composition comprising any of the foregoing may be administered in conjunction with an agent known or believed to interfere with DNA replication. An IL-7Rα binding compound, or a pharmaceutical composition comprising an IL-7Rα binding compound may be administered in conjunction with an agent known or believed to interfere with DNA repair.

Compounds provided by the present disclosure can be useful in vitro as tools for understanding the biological role of IL-7, including the evaluation of the many factors thought to influence, and be influenced by, the production of IL-7 and the receptor binding process. The present compounds are also useful in the development of other compounds that bind to and activate the IL-7R, because the present compounds provide useful information concerning the relationship between structure and activity that should facilitate such development.

The compounds are also useful as competitive binders in assays to screen for new IL-7 receptor antagonists. In such assay embodiments, the compounds of the invention can be used without modification or can be modified in a variety of ways; for example, by labeling, such as covalently or non-covalently joining a moiety which directly or indirectly provides a detectable signal. In any of these assays, the materials thereto can be labeled either directly or indirectly. Possibilities for direct labeling include label groups such as: radiolabels such as $^{125}$I, enzymes such as peroxidase and alkaline phosphatase, and fluorescent labels capable of monitoring the change in fluorescence intensity, wavelength shift, or fluorescence polarization. Possibilities for indirect labeling include biotinylation of one constituent followed by binding to avidin coupled to one of the above label groups. The compounds may also include spacers or linkers in cases where the compounds are to be attached to a solid support.

Based on their ability to bind to the IL-7 receptor, the peptides provided by the present disclosure can be used as reagents for detecting IL-7 receptors, for example, on living cells, fixed cells, in biological fluids, in tissue homogenates, in purified, and natural biological materials. For example, by labelling such peptides, one can identify cells having IL-7 receptor on their surfaces. In addition, based on their ability to bind the IL-7 receptor, the peptides of the present invention can be used, for example, in in situ staining, FACS (fluorescence-activated cell sorting), Western Blotting, and ELISA. In addition, based on their ability to bind to the IL-7 receptor, peptides provided by the present disclosure can be used in receptor purification, or in purifying cells expressing IL-7 receptors on the cell surface (or inside permeabilized cells).

The compounds provided by the present disclosure can also be utilized as commercial reagents for various medical research and diagnostic uses. Such uses include, for example, (1) use as a calibration standard for quantitating the activities of candidate IL-7 agonists in a variety of functional assays; (2) use to maintain the proliferation and growth of IL-7-dependent cell lines; (3) use in structural analysis of the IL-7 receptor through co-crystallization; (4) use to investigate the mechanism of IL-7 signal transduction/receptor activation; and (5) other research and diagnostic applications wherein the IL-7 receptor is preferably activated or such activation is conveniently calibrated against a known quantity of an IL-7R agonist.

IL-7Rα binding compounds provided by the present disclosure can be useful when combined with certain vaccines, including cancer neo-antigen vaccines. Mutations in tumor DNA produce new protein sequences that are foreign to the body. Vaccines can be designed to specifically activate a patient's immune system with respect to tumor-specific neoantigens. When administered in combination with a neo-antigen vaccine, IL-7Rα binding compounds provided by the present disclosure can expand and proliferate neo-antigen-specific T-cells in the tumor microenvironment and thereby drive maximal expansion of vaccine-induced neoantigen-specific T-cells for the treatment of cancer.

IL-7Rα ligands and IL-7Rα constructs provided by the present disclosure can be used as adjuvants. An adjuvant refers to a compound that enhances the efficacy of a vaccine without directly participating in the protective immunity. For example, an IL-7Rα binding compound provided by the present disclosure can be used in conjunction with a cancer vaccine.

Recent research suggests that IL-7 can serve as an effective vaccine adjuvant. For example, IL-7Rα is expressed on the majority of resting, naive CD8+ T cells; IL-7 signaling recruits T cells specific for low-affinity antigens into the proliferative pool in lymphopenic hosts; and, as with other Rγc cytokines, IL-7 prevents programmed cell death. Because IL-7 is important during the expansion and development of effector T-cells into memory T-cells, it is reasonable that IL-7 could be used to stimulate the development and expansion of effector T cells during vaccination.

Administration of IL-7 has been shown therapeutic potential for augmenting the immune response and can enhance the effectiveness of vaccine-induced T cell responses.

For example, co-delivery of hIL-7 DNA augmented multigenic HCV DNA vaccine-induced T cell responses in a non-human primate model.

In bacterial infections, therapeutic potential of IL-7 in the setting of sepsis mouse model was proven by increasing the number of recruited neutrophils.

Therapies involving administration of IL-7 showed enhanced virus-specific T cell responses which led to viral clearance in a chronic lymphocytic choriomeningitis (LCMV) mouse infection model. Administration of recombinant IL-7 during the contraction phase of CD8+ T cell responses elicited in response to DNA vaccines increased the number of LCMV-specific memory T-cells.

In a murine model of influenza A virus (IAV) it was demonstrated that a single intranasal pretreatment with Fc-fused IL-7 (IL-7-mFc), but not a native form of IL-7, protected mice from IAV-induced mortality for an extended period of time, even without preexisting IAV-specific immunity. IL-7-mFc treatment induced altered immune environments in the lung, with prolonged occupancy of lung-retentive effector/memory phenotype T (TRM-like) cells, which play an essential role in protection from IAVs by limiting viral replication and immunopathology, while helping IAV-specific cytotoxic T lymphocytes (CTLs) to propagate.

In another study, in which a recombinant RABV (rRABV) that expressed mouse IL-7 was administered to mice, it was found that overexpressing IL-7 improved the production of long-lasting primary and secondary antibody responses to RABV infection.

It has been reported that recombinant IL-7 protein enhances the survival of *Mycobacterium tuberculosis*-infected mice by the activation of antigen-specific effector CD8+ T cells.

Furthermore, IL-7-expressing plasmids can enhance vaccine-induced CTL and/or Th2-type immune responses in mice injected with HSV-2 gD DNA vaccine.

In another study a DNA vaccine encoding the VP1 capsid protein of foot and mouth disease virus was co-delivered to mice with an IL-6 expressing plasmid as an initial adjuvant and boosted with an IL-7 expressing plasmid as a secondary adjuvant. Mice immunized with pVAX-IL-6 and boosted with pVAX-IL-7 produced the highest expression of CD44high CD62Llow in activated CD4+ T cells.

IL-7Rα ligands and IL-7Rα ligand constructs provided by the present disclosure can be useful for cell therapy when engineered to be expressed on the membrane surface of cells that also express the IL-7Rα subunit. Adoptive immunotherapy using NK cells or using re-targeted chimeric antigen receptor (CAR) T-cells is currently being studied as a treatment for neoplasms and viral infections. One challenge with these cell therapies is the suboptimal sustained survival of the infused cells.

DNA encoding an IL-7Rα binding compound fused to a membrane protein in such a way that the IL-7Rα binding compound is expressed on the extracellular surface of a cell can be constructed using standard techniques. When the fusion protein comprising the IL-7Rα binding compound is expressed, IL-7 receptors on the cell can become activated leading to long-term persistence of the cell.

DNA encoding an IL-7Rα binding compound can be incorporated into a cell and can be configured to produce an IL-7Rα binding compound provided by the present disclosure. The IL-7Rα binding compound can be secreted from the cell and can interact with the secreting cells (i.e., autocrine signaling) and/or cells in the vicinity of the secreting cell (i.e., paracrine signaling). A secreted IL-7Rα binding compound provided by the present disclosure can be an IL-7R agonist and can be designed to localize near the secreting cell.

An IL-7Rα binding compound provided by the present disclosure can be used to expand non-regulatory T-cells within a patient or within a biological sample. Methods of increasing the ratio of non-regulatory T-cells to Treg cells can comprise contacting a population of T-cells with an effective amount of an IL-7Rα binding compound. The ratio can be measured by determining the ratio of CD3+FOXP3+ cells to CD3+FOXP3-cells within the population of T-cells. A typical Treg frequency in human blood is 5% to 10% of the total CD4+CD3+ T-cells, however, in certain diseases this percentage may be lower or higher.

An IL-7Rα binding compound can be used to expand NK cells. NK cells modified with chimeric antigen receptors (CARs), which redirect immune cell activity to target cancer cells have been demonstrated to exhibit improved antitumor responses. CARs can comprise an antibody-derived extracellular domain, which binds to the desired tumor-associated antigen (TAA) and triggers an intracellular signaling cascade to activate the immune cell against the target cells.

NK cells can be genetically engineered for enhanced expression of one or more tumor targeting receptors such as NKG2D with membrane-bound IL-7Rα binding compound, which can prolong the persistence and potency of the NK cells.

CAR T-cells can be genetically engineered to co-express a tethered form of an IL-7Rα binding compound provided by the present disclosure to support in vivo persistence and maintenance of an immature state of differentiation and to exhibit in vivo antitumor activity.

An IL-7Rα binding compound or a pharmaceutical composition thereof may be administered to a patient together with another compound for treating an inflammatory disease or an autoimmune disease in the patient. The at least one other therapeutic agent may be a different IL-7Rα binding compound provided by the present disclosure. An IL-7Rα binding compound and the at least one other therapeutic agent may act additively or synergistically. The at least one additional therapeutic agent may be included in the same pharmaceutical composition or vehicle comprising the IL-7Rα binding compound or may be in a separate pharmaceutical composition or vehicle. Accordingly, methods provided by the present disclosure further include, in addition to administering an IL-7Rα binding compound, administering one or more therapeutic agents effective for treating an inflammatory disease or an autoimmune disease or a different disease, disorder or condition than an inflammatory disease or an autoimmune disease. Methods provided by the present disclosure include administering IL-7Rα binding compound and one or more other therapeutic agents provided that the combined administration does not inhibit the therapeutic efficacy of the IL-7Rα binding compound and/or does not produce adverse combination effects.

Compounds provided by the present disclosure can be useful in vitro as tools for understanding the biological role of IL-7, including the evaluation of the many factors thought to influence, and be influenced by, the production of IL-7 and the receptor binding process. The present compounds are also useful in the development of other compounds that bind to and activate the IL-7R, because the present compounds provide useful information concerning the relationship between structure and activity that should facilitate such development.

The compounds are also useful as competitive binders in assays to screen for new IL-7 receptor agonists and antagonists. In such assays, IL-7Rα binding compounds can be used without modification or can be modified in a variety of ways; for example, by labeling, such as covalently or non-covalently joining a moiety which directly or indirectly provides a detectable signal. In any of these assays, the materials thereto can be labeled either directly or indirectly. Possibilities for direct labeling include label groups such as: radiolabels such as $^{125}I$, enzymes such as peroxidase and alkaline phosphatase, and fluorescent labels capable of monitoring the change in fluorescence intensity, wavelength shift, or fluorescence polarization. Possibilities for indirect labeling include biotinylation of one constituent followed by binding to avidin coupled to one of the above label groups. The compounds may also include spacers or linkers in cases where the compounds are to be attached to a solid support.

Based on their ability to bind to IL-7R, IL-7Rα binding compounds provided by the present disclosure can be used as reagents for detecting IL-7R, for example, on living cells, fixed cells, in biological fluids, in tissue homogenates, in purified, and natural biological materials. For example, by labeling such peptides, one can identify cells expressing the IL-7Rα subunit. In addition, based on their ability to bind to IL-7R, the IL-7Rα binding compounds of the present disclosure can be used, for example, in in situ staining, FACS (fluorescence-activated cell sorting), Western Blotting, and ELISA. In addition, based on their ability to bind to IL-7R, IL-7Rα binding compounds provided by the present disclosure can be used in receptor purification, or in purifying cells expressing IL-7R on the cell surface (or inside permeabilized cells).

IL-7Rα binding compounds provided by the present disclosure can also be utilized as commercial reagents for various medical research and diagnostic uses. Such uses include, for example, (1) use as a calibration standard for quantitating the activities of candidate IL-7R agonists in a variety of functional assays; (2) use to maintain the proliferation and growth of IL-7-dependent cell lines; (3) use in structural analysis of IL-7R through co-crystallization; (4) use to investigate the mechanism of IL-7R signal transduction/receptor activation; and (5) other research and diagnostic applications where IL-7R is activated or such activation is conveniently calibrated against a known quantity of an IL-7R agonist.

Aspects provided by the present disclosure include compounds capable of binding to the unique binding site of the IL-7Rα subunit with an $IC_{50}$ of less than 100 µM, less than 10 µM, less than 1 µM, less than 100 nM, or less than 10 nM.

Aspects provided by the present invention comprise treating a disease in a patient such as cancer, an inflammatory disease, or an autoimmune disease comprising administering to a patient in need thereof a therapeutically effective amount of a compound capable of binding to the unique binding site of the IL-7Rα subunit with an $IC_{50}$ of less than 100 µM, less than 10 µM, less than 1 µM, less than 100 nM, or less than 10 nM.

Aspects of the present invention include nucleic acids encoding for an IL-7Rα binding compound provided by the present disclosure.

A nucleic acid or isolated polynucleotide encoding an IL-7Rα provided by the present disclosure can be incorporated into expression vectors depending in part on the host cells used to produce the IL-7Rα binding compound. Generally, the nucleic acids can be operably linked to any number of regulatory elements such as, for example, promoters, origin of replication, selectable markers, ribosomal binding sites, and/or inducers. The expression vectors can be extra-chromosomal or integrating vectors.

The nucleic acids and/or expression can be transformed into any number of different types of host cells including mammalian, bacterial, yeast, insect and/or fungal cells, with mammalian cells such as CHO cells.

A nucleic acid encoding an IL-7Rα binding compound can comprise a first nucleic acid sequence encoding an IL-7Rα ligand; a second nucleic acid sequence encoding a peptidyl ligand linker; and a third nucleic acid sequence encoding an IL-7Rα ligand, an Rγc ligand, and/or a construct partner.

A nucleic acid encoding an IL-7Rα ligand fusion protein can comprise a first nucleic acid sequence encoding the IL-7Rα ligand provided by the present disclosure; and a second nucleic acid sequence encoding a fusion partner. A nucleic acid encoding an IL-7Rα ligand fusion protein can comprise a nucleic acid encoding an IL-7Rα ligand and the fusion partner. A nucleic acid encoding an IL-7Rα ligand fusion protein can further comprise a nucleic acid segment encoding a construct linker and a nucleic acid encoding an IL-7Rα ligand fusion protein can comprise a nucleic acid encoding an IL-7Rα ligand, the fusion partner, and the construct linker.

The fusion partner can comprise, for example, HSA, an Fc-fragment, an IgG, an antibody directed to a cell-specific antigen, and an antibody directed to a cell-specific receptor.

A nucleic acid encoding an IL-7Rα fusion protein can further comprise a nucleic acid encoding a peptidyl linker, where the peptidyl linker is configured to bind the IL-7Rα ligand to the fusion partner.

A nucleic acid provided by the present disclosure can encode a fusion protein comprising an IL-7Rα ligand, and a linker binding the C-terminus of the IL-7Rα ligand to HSA.

A nucleic acid provided by the present disclosure can encode a fusion protein comprising a dimeric Fc-Fragment of IgG1, IgG2, or IgG4, an IL-7Rα ligand, and a linker binding the N-terminus of an IL-7Rα ligand to the C-terminus of one CH3 domain of the dimeric Fc-fragment.

A nucleic acid provided by the present disclosure can encode a fusion protein comprising a dimeric Fc-Fragment of IgG1, IgG2, or IgG4, two IL-7Rα ligands, and a linker binding the N-terminus of each of the two IL-7Rα ligands to the C-terminus of each CH3 domain of the dimeric Fc-fragment.

A nucleic acid provided by the present disclosure can encode a fusion protein comprising a heavy chain of an immunoglobulin molecule such as IgG1, IgG2, or IgG4, an IL-7Rα ligand, and a Fc linker bonding the N-terminus of the IL-7Rα ligand to the C-terminus of the Fc region.

A nucleic acid provided by the present disclosure can encode for an IL-7Rα ligand comprising an amino acid sequence of any one of SEQ ID NOS: 1-410, or can encode for an amino acid sequence comprising an amino acid sequence having greater than 60%, greater than 70%, greater than 80%, greater than 85%, greater than 90%, or greater than 95% sequence similarity to any one of SEQ ID NOS: 1-410.

A nucleic acid provided by the present disclosure can encode for an IL-7Rα ligand binding compound comprising an amino acid sequence of any one of SEQ ID NOS: 520-655 or can encode for an amino acid sequence having greater than 60%, greater than 70%, greater than 80%, greater than 85%, greater than 90%, or greater than 95% sequence similarity to any one of SEQ ID NOS: 520-655.

A nucleic acid provided by the present disclosure can encode for an IL-7Rα ligand binding compound comprising an amino acid sequence of any one of SEQ ID NOS: 411-428 or can encode for an amino acid sequence having greater than 60%, greater than 70%, greater than 80%, greater than 85%, greater than 90%, or greater than 95% sequence similarity to any one of SEQ ID NOS: 411-428.

A nucleic acid provided by the present disclosure can encode for an IL-7Rα ligand binding compound comprising an amino acid sequence of any one of SEQ ID NOS: 597-655 or can encode for an amino acid sequence having greater than 60%, greater than 70%, greater than 80%, greater than 85%, greater than 90%, or greater than 95% sequence similarity to any one of SEQ ID NOS: 597-655.

A nucleic acid provided by the present disclosure can encode for a homomeric IL-7Rα ligand comprising two or more IL-7Rα ligands provided by the present disclosure.

Aspects of the invention further include a host cell comprising an expression vector comprising a nucleic acid encoding an IL-7Rα ligand or an IL-7Rα binding compound provided by the present disclosure.

Methods provided by the present disclosure include methods of making an IL-7Rα ligand or an IL-7Rα binding compound provided by the present disclosure, comprising culturing a host cell, wherein the host cell comprises an expression vector comprising a nucleic acid encoding an IL-7Rα ligand or an IL-7Rα binding compound provided by the present disclosure, under conditions where the IL-7Rα ligand or the IL-7Rα binding compound is expressed, and recovering the expressed IL-7Rα ligand or IL-7Rα binding compound.

EXAMPLES

The following examples describe in detail methods of synthesizing IL-7Rα ligands, methods of synthesizing IL-7Rα binding compounds, and methods of determining the activity of IL-7Rα ligands and IL-7Rα binding compounds provided by the present disclosure and the experimental results. The following examples also describe in detail methods for determining properties of the IL-7Rα ligands and IL-7Rα binding compounds provided by the present disclosure. It will be apparent to those skilled in the art that many modifications, both to materials and methods, may be practiced without departing from the scope of the invention.

In the examples, the IL-7Rα subunit refers to human IL-7Rα (CD127 protein, Fc Tag) (21-236), Accession No. P16871-1 and was obtained from ACRObiosystems, Inc., product number ILB-H5258.

Example 1

Phage Display pIII Library Panning Against Fc-Fusions on Magnetic Beads (Acid Elution) Library Panning Procedure Fifty (50) μL of Protein G Dynabeads® (Invitrogen) was used for each library sample. After resuspending the stock bottle, the desired volume of beads was transferred to a sterile microfuge tube and applied to the magnet.

With the beads on a magnet, the supernatant was removed, and the beads were washed with 1 mL of PT buffer (1×PBS, 0.05% Tween®20).

The supernatant was removed and 1 mL of PBS+1% BSA+0.05% Tween®20 was added and mixed at 25° C. for at least 1 hour to block the beads.

A tube was applied to the magnet and the blocking solution was removed. For each library to be tested, 5 μg of a Fc-fused receptor of interest was added to each library sample for each round to bring the total volume to at least 400 μL. The samples were mixed at 25° C. for at least 1 h. The sample was applied to the magnet and the supernatant was removed.

Two-hundred 200 μL of PT buffer was added for each 50 μL of bead. The sample was thoroughly mixed and 200 μL aliquots were transferred into tubes that were pre-labeled for each library to be screened. An additional 500 μL of PT buffer was added to each tube, the samples mixed, and then applied to the magnet. A total of 700 μL/tube was used for the wash.

The wash was removed and 500 μL of 250 nM Fc blocking peptide diluted in PBT (PBS+0.5% BSA+0.05% Tween®20) was added to each sample. The stock concentration was 25 μM (100×). The samples were incubated at 4° C. for at least 30 min while rotating. Following the incubation, the samples were applied to the magnet and the blocking peptide solution was removed prior to adding the libraries. One (1) mL aliquots of the libraries were removed from the −20° C. freezer. One hundred (100 μL of 10×PBT buffer (5% BSA, 0.5% Tween®20 in 1×PBS) was added to each tube and vortexed. Eleven (11) μL of Fc blocking peptide was added to each library sample and vortexed. The library samples were transferred to pre-labeled tubes containing beads. The samples were then incubated at 4° C. on the rotator for at least 2 h. For the additional rounds of screening, 0.5 mL aliquots of the amplification from the previous round from each library was used. Fc blocking peptide was then added at the concentration indicated in step 6 (10 μL blocking peptide).

The beads were recovered with the magnet and the phage solution removed. The beads were washed twice with 1 mL of PT buffer. Five hundred (500) μL of PT buffer was added and the suspension was transferred to a clean tube. The beads were recovered on the magnet and the final wash was removed.

Four-hundred seventy-five (475) μL of phage elution buffer was added to each well (0.2 M glycine-HCL, pH 2.2, 1 mg/mL BSA). The samples were incubated at 25° C. for 10 min on the rotator. The beads were recovered on the magnet and the eluted phage transferred to a clean tube.

Twenty-five (25) μL of neutralization buffer (2 M Tris Base) was added to the 475 μL of elution. The neutralized samples were maintained at 4° C. until the TG1 cells were ready amplification. The samples were stored at −20° C. after screening. Fifty (50) μL (about 10% of the total volume) was transferred to a 1.5 mL microfuge tube and stored at −20° C. for use in deep sequencing.

Example 2

TG1 Culture and Library Amplification

A fresh TG1 (or OmniMax) culture was grown for about 1 to 1.5 h after adding the libraries to the beads. 2X-YT medium (10 mL) was placed into a 50 mL Falcon® tube.

Two hundred (200) μL of the TG1 overnight was added to the falcon tube. 2X-YT medium (600 μL) was placed in a cuvette for OD600 blank. The culture was grown at 250 rpm at 37° C., taking the first OD measurement after 60 min. The TG1 cells should be in log phase at the time of use with an OD600 of 0.5-0.7.

Eluted phage (400 μL to 450 μL) was added to 1 mL of the TG1 cells at an OD600 of 0.5-0.7 in a 50 mL Falcon® tube. The phage and TG1 cells were incubated at 37° C. for 30 min without shaking. About 50 to 100 μL was set aside for titering and characterization.

2YT medium (10.5 mL) was added to 12 μL of carbenicillin (carb) (100 mg/mL to make 100 μg/mL) and 24 μL of 50% glucose (to make 0.1% glucose) and the cells incubated while shaking at 37° C. at 250 rpm until turbid.

M13K07 helper phage ($5 \times 10^{10}$ pfu) was then added and swirled to mix. The phage and cells were incubated at 37° C. for 30 min without shaking.

Kanamycin was diluted to 3 mg/mL and arabinose to 2.4% in 2YT medium/Carbenicillin-100/0.1% glucose and 100 μL was added to each amplification. The mixture was incubated overnight at 37° C. and 250 rpm.

The culture was transferred to a 50 mL high-speed VWR centrifuge tube and centrifuged at 8,000 g for 15 min at 4° C. in a JSP-F50C centrifuge to pellet the cells.

The supernatant was transferred to a 50 mL high-speed VWR centrifuge tube and 0.2 volumes of PEG/NaCl was added, mixed, and incubated on ice for 30 min.

The cells were then centrifuged at 10,500 g for 15 min at 4° C. using a JSP-F50C centrifuge. The supernatant was removed, and the phage pellet was resuspended in a total of 1 mL of PBT (1×PBS, 0.05% Tween®20, 0.5% BSA) by pipetting.

The sample was transferred to an Eppendorf tube, vortexed, and centrifuged at 12,000 rpm for 30 sec. The supernatant was transferred to a clean Eppendorf tube and stored at 4° C. This amplified phage sample (250-500 μL) was used for the next round of screening.

Example 3

Preparation of Cultures from Individual Colonies

Ninety-six (96) wells of a deep well plate were filled with 1 mL of 2YT broth/carbenicillin-100/0.1% glucose. Ninety-six (96) colonies were placed into the wells using P20 tips. The tips were left in the wells to mark the position. The tips were removed using a multi-channel pipette after the entire plate was completed. The plate was covered with a breathable film.

The inoculated plate(s) were incubated in a shaker at 37° C. until the cultures became turbid, typically within 4 h at 250 rpm.

The plate(s) was removed from the incubator and 50 μL of the culture from each well was removed to another deep well block designated as the "Archive Block" containing 1 mL of 2YT broth/carbenicillin-100/0.1% glucose. The plate(s) were covered with a breathable film and incubated overnight at 37° C. and 250 rpm.

After removing cells for archive plate, M13K07 helper phage was added to $2 \times 10^{10}$ pfu/mL in 2YT broth/carbenicillin-199/0.1% glucose (make 6.0 mL per block). Fifty (50) μL of the diluted M13K07 was added to each culture well in the deep well block. The deep well block was covered with breathable film and incubated for 30 min at 37° C. and 250 rpm.

Kanamycin was diluted to 0.5 mg/mL and arabinose to 0.4% in 2YT broth/ampicillin-50/0.1% glucose (make 6.0 ml per block) and 50 μL was added to each well. The plate was covered with a breathable film and incubated overnight at 37° C. and 250 rpm.

The "Archive Block" culture was removed from the incubator and 50 μL was transferred to a 96-well plate containing 50 μL of 50% glycerol. The plate was sealed with foil and stored at −80° C. The remaining culture in the block was covered with a foil seal and stored at 4° C.

The block was centrifuged at 4000 rpm for 15 min. While avoiding the bacterial pellet, 850 μL of the phage supernatant was transferred to a fresh deep well plate, covered with a foil seal, and stored at 4° C.

Example 4

Phage ELISA Protocol

For each block to be assayed, a 1×96 well ELISA plate was coated with Fc-fused receptor target (1 μg/mL in PBS) at 50 μL/well. The wells were incubated at 25° C. for at least 1 h.

The Fc-fused receptor target was removed from each well. Three-hundred (300) μL of blocking buffer (1×PBS, 1% BSA) was added to each well of a receptor-coated plate. Also, 300 μL of the blocking buffer was added to a separate uncoated 96-well ELISA plate to be used as the negative control. Both plates were covered with film and left at 37° C. for 1 h or overnight at 4° C.

The plate was washed 4 times with PT (1×PBS, 0.05% Tween®20) buffer.

Fifty (50) μL of PBT was added to each well. Fifty (50) μL of the phage supernatant from the block was added to each well and incubated at 4° C. for 1 h.

The plates were washed 4 times with cold PT buffer.

To each well 50 μL of anti-M13-HRP antibody diluted 1:5000 in cold PBT was added. The wells were incubated for 1 h at 4° C.

The plates were then washed 4 times with cold PT.

Fifty (50) μL of TMB was then added to each well, and the wells were incubated for 1-10 min at 25° C. Fifty (50) μL of a "stop" solution was added and the plate read at 450 nm.

Example 5

Identified Peptides

Twenty stochastic peptide libraries, each containing approximately 10E10 independent recombinants, and each clone potentially displaying a unique peptide sequence, were screened for binding to human IL-7Rα subunit extracellular domain (ECD). In screening each of these primary libraries against IL-7Rα ECD, phage clones with 78 unique peptides were identified and confirmed to be ligands of IL-7Rα. These IL-7Rα ligands were grouped into at least four sequence families: Families 1, 2 and 3, and 4, exhibiting distinct consensus sequence groupings. None of these peptide families have sequence similarity to human IL-7.

IL-7Rα ligands having SEQ ID NOS: 4-8, 14-21, 27-49, 56-73, 78-105, 112-183, 190-349, 356-388, 393-410 exhibited a direct binding to the hIL-7Rα subunit with an $IC_{50}$ of less than 100 μM as determined by phage ELISA assays.

IL-7Rα ligands having SEQ ID NOS: 393-410 bind to the hIL-7Rα subunit with an $IC_{50}$ of less than 10 μM as determined by phage ELISA competition assays.

Example 6

Chemical Synthesis of IL-7Rα.Ligands

2-Cholorotrityl resin (1 g, 1.5 mmole/g, from Anaspec) was washed with DMF (2×), and then allowed to stand in 50 mL DMF for 10 min. The swollen resin was treated with an activated solution of Fmoc-glycine prepared from 5 eq. of amino acid and 5 eq. of HATU dissolved at 0.5M in DMF, followed by the addition of 10 eq. of DIEA, and the mixture gently stirred for 30 min at 25° C. The resin was washed (DMF, THF, DCM, and MeOH) and dried to yield the Fmoc-protected resin. Fmoc groups were then removed by gently shaking the resin with 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to build a desired amino acid sequence. Except for examples with four cysteine residues in the sequence, standard 95% TFA-labile amino acid sidechain protecting groups were used. With compounds with four cysteines, the two cysteine residues proximal to the resin, Trt protection was used, and for the two cysteine residues distal to the resin, Acm protection was used. After Fmoc removal from the final amino acid of the dimer sequence, in some cases the terminal amine groups were acylated with acetic anhydride (10 eq.) and DIEA (20 eq.) in DMF for 20 min, followed by washing as described above.

The completed peptide was cleaved from the resin by suspension in a solution of TFA (95 vol %), water (2.5 vol %), and triisopropylsilane (2.5 vol %) for 3 h at 25° C. The TFA solution was cooled to 5° C. and poured into $Et_2O$ to precipitate the peptide. Filtration and drying under reduced pressure gave the desired peptide. Purification via preparative HPLC with a C18 column afforded the pure peptide with the two C-terminal thiol groups in a reduced state. This peptide was dissolved in 20% DMSO/water (1 mg dry weight peptide/mL) and allowed to stand at 25° C. for 36 h, and then purified by reverse phase HPLC to provide the peptide with the two C-terminal thiols linked by a disulfide bridge. In compounds containing four cysteines, the two N-terminal Acm-protected cysteine residues were then deprotected by dissolving 0.1 mmole of peptide in 25 mL of 50% acetic acid/$H_2O$ and 2.5 mL of 1M HCl and adding 5 mL of 0.1M iodine (in glacial acetic acid; 5 eq.) dropwise with stirring under a nitrogen atmosphere. The deprotection/oxidation reaction was allowed to proceed for 2 h at 25° C. with frequent monitoring (analytical HPLC) to ensure complete reaction. The reaction was stopped by addition of ice-cooled diethyl ether (9 volume eq.). The resulting solution was cooled on dry ice (3 min), the ether solution carefully decanted, and the resulting light-yellow solid purified by preparative reverse phase HPLC (95%) to yield the final peptide dimer having an IL-7Rα and an Rγc ligand.

Example 7

Synthesis of IL-7Rα/Rγc Heterodimers Using Click Chemistry

The peptide sequences of IL-7Rα ligands and an Rγc ligand were synthesized separately using standard solid phase synthesis conditions and Fmoc-protected amino acids as described in Example 6.

Rink amide-MBHA resin (1 g, 1.5 mmole/g, Anaspec) was washed with DMF (2×), and then allowed to stand in 50 mL DMF for 10 min. Separate portions of the swollen resin were treated with either an activated solution of Fmoc-propargyl glycine (IL-7Rα ligand) or 2-(Fmoc-NH)-5-azido-pentanoic acid (Rγc ligand) prepared from 5 eq. of amino acid and 5 eq. of HATU dissolved at 0.5M in DMF, followed by the addition of 10 eq. of DIEA, and the mixture was gently stirred for 30 min at 25° C. The resin was washed (DMF, THF, DCM, and MeOH) and dried to yield the Fmoc-protected resin. Fmoc groups were then removed by gently shaking the resin in 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to provide a desired Rγc ligand amino acid sequence and a desired IL-7Rα ligand amino acid sequence. Standard 95% TFA-labile amino acid sidechain protecting groups were used for all residues. After Fmoc removal from the final amino acid of each ligand sequence, the terminal amine groups were acylated with acetic anhydride (10 eq.) and DIEA (20 eq.) in DMF for 20 min.

Each completed ligand was cleaved from the resin by suspension in a solution of TFA (95%), water (2.5%), and triisopropylsilane (2.5%) for 3 h at 25° C. The TFA solution was cooled to 5° C. and poured into $Et_2O$ to precipitate the peptide. Filtration and drying under reduced pressure gave the desired ligands. Purification via preparative HPLC with a C18 column afforded the pure peptides with the two thiol groups in a reduced state. The ligands were separately dissolved in 20% DMSO/water (1 mg dry weight peptide/mL), allowed to stand at 25° C. for 36 h, and then purified by reverse phase HPLC to provide the IL-7Rα and Rγc ligands with the two thiols linked via an intramolecular disulfide bridge.

Two-tenths (0.2) mL of a 2.0 mM solution of purified alkyne-containing IL-7Rα ligand was prepared by dissolving the ligand in 1:1 $H_2O$/tBuOH. Similarly, 0.2 mL of a 2.4 mM solution of the purified azide-containing ligand was prepared using the same solvent. The two ligand solutions along with 0.1 mL of 100 mM $CuSO_4$ in $H_2O$, 0.1 mL of 250 mM of a Cu(I) chelating agent such as DIEPA, pyridine, or THPTA (tris(3-hydroxypropyltriazolylmethyl)amine), in 3:1 DMSO/tBuOH, 0.1 mL of 0.5 M ascorbic acid in $H_2O$, and 0.3 mL of 3:2 tBuOH/$H_2O$ were combined, and the reaction allowed to proceed at 45° C. under anaerobic conditions. Reaction progress was monitored frequently by LC/MS, and additional azide-containing ligand and $CuSO_4$ were added to drive the reaction to completion. After the maximal amount of alkyne was consumed (approx. 3 h), the reaction was quenched by addition of approx. 8 mL of 1:1 $H_2O$/ACN, and the peptide dimer purified (95%) using a preparative-scale C18 HPLC column.

The structure of heterodimers comprising an IL-7Rα ligand and an Rγc ligand are shown in FIG. 1. The structures of the termini of the IL-7Rα and Rγc ligands and the structure of the linkers for the heterodimers is shown in Tables 1-3.

Example 8

Recombinant hIgG-Fc IL-7Rα/Rγc Fusion Proteins

Immunoglobulin Fc Fusions: mammalian expression vectors were constructed to express IL-7Rα ligands linked to Fc-fragments consisting of the CH2 and CH3 domains of the heavy chain and hinge regions of human IgG2. Each vector contained a strong constitutive promoter (CMV or hEF1-HTLV) and an IL-7 signal peptide sequence for secretion of the fusion protein into the culture media. Vectors were designed to enable peptide ligands to be fused to the C-terminus of the immunoglobulin proteins and to incorporate construct linkers of varying lengths between the IL-7Rα ligand and IgG.

Fusion proteins were transiently expressed in 293 human embryonic kidney cells (FreeStyle® 293-F) by transfecting plasmid DNA into the cells using polyethyleneimine reagent PEI MAX (Polysciences, Inc.). Transfected cells were grown in FreeStyle® 293 Expression Medium (Thermo Fisher) in shaker flasks in a 37° C. humidified $CO_2$ incubator on an orbital shaker rotating at 125 rpm. Cultures were harvested 96 h post-transfection by centrifugation and the secreted fusion proteins were purified from the supernatants using protein A affinity chromatography.

Protein A agarose resin was mixed with culture supernatant and incubated at 25° C. for several hours. The resin was then washed three times with PBS and bound IgG IL-7Rα ligand fusion was eluted with 0.1 M glycine buffer (pH 2.8). Eluates were neutralized with 1M Tris buffer and quantified by measuring absorbance at 280 nm using a NanoDrop® spectrophotometer. Protein concentrations were determined using calculated extinction coefficients derived from the primary sequence of the protein.

The full amino acid sequences of recombinant hIgG-Fc IL-7Rα/Rγc fusion proteins are shown in Table 4.

TABLE 4

Recombinant hIgG-Fc IL-7Rα/Rγc fusion proteins.

| | |
|---|---|
| SEQ ID NO: 411 | APLERKSSVECPPCPAPPVAGPSVFLFPPKPKDTLMISRTPEVTCV VVDVSHEDPEVQFNWYVDGVEVHNAKTKPREEQFNSTFRVVSV LTVVHQDWLNGKEYKCKVSNKGLPAPIEKTISKTKGQPREPQVY TLPPSREEMTKNQVSLTCLVKGFYPSDIAVEWESNGQPENNYKT TPPMLDSDGSFFLYSKLTVDKSRWQQGNVFSCSVMHEALHNHY TQKSLSLSPGARTGGGGSGGGGSIEGRGGQCIHWDIETLLSCVGG GGSGGVVCQDWEGVELCWQGG |
| SEQ ID NO: 412 | APLERKSSVECPPCPAPPVAGPSVFLFPPKPKDTLMISRTPEVTCV VVDVSHEDPEVQFNWYVDGVEVHNAKTKPREEQFNSTFRVVSV LTVVHQDWLNGKEYKCKVSNKGLPAPIEKTISKTKGQPREPQVY TLPPSREEMTKNQVSLTCLVKGFYPSDIAVEWESNGQPENNYKT TPPMLDSDGSFFLYSKLTVDKSRWQQGNVFSCSVMHEALHNHY TQKSLSLSPGARTGGGGSGGGGSIEGRGGVPWCTLDPGSLQCAW FGGGGSGGVVCQDWEGVELCWQGG |
| SEQ ID NO: 413 | APLERKSSVECPPCPAPPVAGPSVFLFPPKPKDTLMISRTPEVTCV VVDVSHEDPEVQFNWYVDGVEVHNAKTKPREEQFNSTFRVVSV LTVVHQDWLNGKEYKCKVSNKGLPAPIEKTISKTKGQPREPQVY TLPPSREEMTKNQVSLTCLVKGFYPSDIAVEWESNGQPENNYKT TPPMLDSDGSFFLYSKLTVDKSRWQQGNVFSCSVMHEALHNHY TQKSLSLSPGARTGGGGSGGGGSIEGRGGRYECADLPGGLHCEF RGGGGSGGVVCQDWEGVELCWQGG |
| SEQ ID NO: 414 | APLERKSSVECPPCPAPPVAGPSVFLFPPKPKDTLMISRTPEVTCV VVDVSHEDPEVQFNWYVDGVEVHNAKTKPREEQFNSTFRVVSV LTVVHQDWLNGKEYKCKVSNKGLPAPIEKTISKTKGQPREPQVY TLPPSREEMTKNQVSLTCLVKGFYPSDIAVEWESNGQPENNYKT TPPMLDSDGSFFLYSKLTVDKSRWQQGNVFSCSVMHEALHNHY TQKSLSLSPGARTGGGGSGGGGSGGRHFDDIIPWCTLDPGSLQCA YLGGGGSGGVVCQDWEGVELCWQGG |
| SEQ ID NO: 415 | APLERKSSVECPPCPAPPVAGPSVFLFPPKPKDTLMISRTPEVTCV VVDVSHEDPEVQFNWYVDGVEVHNAKTKPREEQFNSTFRVVSV LTVVHQDWLNGKEYKCKVSNKGLPAPIEKTISKTKGQPREPQVY TLPPSREEMTKNQVSLTCLVKGFYPSDIAVEWESNGQPENNYKT TPPMLDSDGSFFLYSKLTVDKSRWQQGNVFSCSVMHEALHNHY TQKSLSLSPGARTGGGGSGGGGSGGHLGVPWCTLDPGSIQCAWL AKHGGGGSGGVVCQDWEGVELCWQGG |
| SEQ ID NO: 416 | APLERKSSVECPPCPAPPVAGPSVFLFPPKPKDTLMISRTPEVTCV VVDVSHEDPEVQFNWYVDGVEVHNAKTKPREEQFNSTFRVVSV LTVVHQDWLNGKEYKCKVSNKGLPAPIEKTISKTKGQPREPQVY TLPPSREEMTKNQVSLTCLVKGFYPSDIAVEWESNGQPENNYKT TPPMLDSDGSFFLYSKLTVDKSRWQQGNVFSCSVMHEALHNHY TQKSLSLSPGARTGGGGSGGGGSGGVVCQDWEGVELCWQGGG GSGGRHFDDIIPWCTLDPGSLQCAYLGG |
| SEQ ID NO: 417 | APLERKSSVECPPCPAPPVAGPSVFLFPPKPKDTLMISRTPEVTCV VVDVSHEDPEVQFNWYVDGVEVHNAKTKPREEQFNSTFRVVSV LTVVHQDWLNGKEYKCKVSNKGLPAPIEKTISKTKGQPREPQVY TLPPSREEMTKNQVSLTCLVKGFYPSDIAVEWESNGQPENNYKT TPPMLDSDGSFFLYSKLTVDKSRWQQGNVFSCSVMHEALHNHY TQKSLSLSPGARTGGGGSGGGGSGGVVCQDWEGVELCWQGGG GSGGHLGVPWCTLDPGSIQCAWLAKHGG |
| SEQ ID NO: 418 | APLERKSSVECPPCPAPPVAGPSVFLFPPKPKDTLMISRTPEVTCV VVDVSHEDPEVQFNWYVDGVEVHNAKTKPREEQFNSTFRVVSV LTVVHQDWLNGKEYKCKVSNKGLPAPIEKTISKTKGQPREPQVY TLPPSREEMTKNQVSLTCLVKGFYPSDIAVEWESNGQPENNYKT TPPMLDSDGSFFLYSKLTVDKSRWQQGNVFSCSVMHEALHNHY |

TABLE 4 -continued

Recombinant hIgG-Fc IL-7Rα/Rγc fusion proteins.

TQKSLSLSPGARTGSGSGSGSGSGSGSGSGSGSGGVHRIPWCTLD
PGGLQCAWLRQMGGGGSGGVVCQDWEGVELCWQGG

SEQ ID NO: 419  APLERKSSVECPPCPAPPVAGPSVFLFPPKPKDTLMISRTPEVTCV
VVDVSHEDPEVQFNWYVDGVEVHNAKTKPREEQFNSTFRVVSV
LTVVHQDWLNGKEYKCKVSNKGLPAPIEKTISKTKGQPREPQVY
TLPPSREEMTKNQVSLTCLVKGFYPSDIAVEWESNGQPENNYKT
TPPMLDSDGSFFLYSKLTVDKSRWQQGNVFSCSVMHEALHNHY
TQKSLSLSPGARTGSGSGSGSGSGSGSGSGSGSGGHCKHWDLES
LLLCVGGGGSGGVVCQDWEGVELCWQGG

The fusion proteins having SEQ ID NOS: 412 and 414-419 exhibited an EC$_{50}$ of less than 10 μM in the TF1-7Rα pSTAT5 assay as described in Example 9.

The amino acid sequences for the IL-7Rα/Rγc heteromers is shown in Table 5.

TABLE 5

Amino acid sequences of IL-7Rα/Rγc heteromers.

| SEQ ID NO: 420 | QCIHWDIETLLSCVGGGGSGGVVCQDWEGVELCWQ |
| SEQ ID NO: 421 | VPWCTLDPGSLQCAWFGGGGSGGVVCQDWEGVELCWQ |
| SEQ ID NO: 422 | RYECADLPGGLHCEFRGGGGSGGVVCQDWEGVELCWQ |
| SEQ ID NO: 423 | RHFDDIIPWCTLDPGSLQCAYLGGGGSGGVVCQDWEGVELCWQ |
| SEQ ID NO: 424 | HLGVPWCTLDPGSIQCAWLAKHGGGGSGGVVCQDWEGVELCWQ |
| SEQ ID NO: 425 | VVCQDWEGVELCWQGGGGSGGRHFDDIIPWCTLDPGSLQCAYL |
| SEQ ID NO: 426 | VVCQDWEGVELCWQGGGGSGGHLGVPWCTLDPGSIQCAWLAKH |
| SEQ ID NO: 427 | VHRIPWCTLDPGGLQCAWLRQMGGGGSGGVVCQDWEGVELCWQ |
| SEQ ID NO: 428 | HCKHWDLESLLLCVGGGGSGGVVCQDWEGVELCWQ |

The amino acid sequences for the IL-7Rα ligands and the Rγc ligands of the IL-7Rα/Rγc heteromers in Table 5 are shown in Table 6. The IL-7Rα ligand and the Rγc ligand were bonded together with a -GGGGSGG- (SEQ ID NO: 9404) ligand linker.

TABLE 6

Amino acid sequences of IL-7Rα ligands and Rγc ligands.

| Heterodimer SEQ ID NO: | IL-7Rα Ligand SEQ ID NO: | Rγc Ligand SEQ ID NO: |
|---|---|---|
| SEQ ID NO: 420 | QCIHWDIETLLSCV SEQ ID NO: 159 | VVCQDWEGVELCWQ SEQ ID NO: 429 |
| SEQ ID NO: 421 | VPWCTLDPGSLQCAWF SEQ ID NO: 313 | VVCQDWEGVELCWQ SEQ ID NO: 429 |
| SEQ ID NO: 422 | RYECADLPGGLHCEFR SEQ ID NO: 17 | VVCQDWEGVELCWQ SEQ ID NO: 429 |
| SEQ ID NO: 423 | RHFDDIIPWCTLDPGSLQCAYL SEQ ID NO: 403 | VVCQDWEGVELCWQ SEQ ID NO: 429 |

TABLE 6 -continued

Amino acid sequences of IL-7Rα ligands and Rγc ligands.

| Heterodimer SEQ ID NO: | IL-7Rα Ligand SEQ ID NO: | Rγc Ligand SEQ ID NO: |
|---|---|---|
| SEQ ID NO: 424 | HLGVPWCTLDPGSIQCAWLAKH SEQ ID NO: 395 | VVCQDWEGVELCWQ SEQ ID NO: 429 |
| SEQ ID NO: 425 | VVCQDWEGVELCWQ SEQ ID NO: 429 | RHFDDIIPWCTLDPGSLQCAYL SEQ ID NO: 403 |
| SEQ ID NO: 426 | VVCQDWEGVELCWQ SEQ ID NO: 429 | HLGVPWCTLDPGSIQCAWLAKH SEQ ID NO: 395 |
| SEQ ID NO: 427 | VHRIPWCTLDPGGLQCAWLRQM SEQ ID NO: 407 | VVCQDWEGVELCWQ SEQ ID NO: 429 |
| SEQ ID NO: 428 | HCKHWDLESLLLCV SEQ ID NO: 394 | VVCQDWEGVELCWQ SEQ ID NO: 429 |

Example 9

Evaluation of IL-7Rα Ligand Constructs for IL-7R Agonist Activity

To assess IL-7R agonist activity in cell-based assays, compounds were tested for their ability to phosphorylate STAT5 in an IL-7-responsive TF-1 cell line. Compounds that exhibited IL-7R agonist activity were also tested in primary human peripheral blood mononuclear cells (PBMC) for IL-7R agonism.

Candidate constructs were tested for induction of STAT5 phosphorylation in TF-1 cell line and engineered to express hIL-7Rα, and in the IL-7Rα-negative parental TF-1 line. TF-1 cells, which are derived from a human erythroleukemia, naturally express IL-2Rγc, but not IL-7Rα. TF-1 cells are engineered to be IL-7-responsive by transfection of IL-7Rα to generate a line referred to as TF-1-7Rα. IL-7Rα expression levels in both cell lines were verified by QPCR and FACS analysis.

Compounds were tested in both TF-1 cell lines. Dose response assays were conducted to determine EC$_{50}$ of the test compounds and to compare response to the test compounds with that of hIL-7.

Compounds exhibiting IL-7Rα agonist activity in the engineered TF-1-7Rα cell line were tested on human primary immune cells, hPBMCs, collected from individual donors (obtained from Stanford University Blood Bank). A substantial fraction of PBMCs from normal donors are responsive to IL-7. To assess IL-7 agonist activity of the test compounds, cells were exposed to the compounds or to hIL-7 and scored for STAT5 phosphorylation by ELISA. As a control to confirm that positive compounds are acting through direct stimulation of IL-7R, the assay was also done with PBMC treated with neutralizing anti-huIL-7 antibody.

The heterodimers listed in FIG. 1 exhibited an $EC_{50}$ of less than 10 µM as determined using the TF1-7Rα pSTAT5 assay. hIL-7 exhibited an $EC_{50}$ of about 0.2 nM in the TF1-7Rα pSTAT5 assay.

IL-7Rα/Rγc Ligand A exhibited an $EC_{50}$ of less than 10 µM as determined using the pSTAT5 assay in resting PBMCs. hIL-7 exhibited an $EC_{50}$ of about 7 pM in the pSTAT5 assay in resting PBMCs.

Example 10

Proliferation of CD4 and CD8 Cells from Human PBMCs

Human PBMCs were isolated from a buffy coat by density gradient centrifugation (Lymphoprep®, Stemcell Technologies #07811) and cultured overnight in T-cell medium (CTS OpTmizer®, ThermoFisher #A1048501) at 3×106 cells/mL in a T75 flask. The following day, cells were resuspended in fresh medium and plated at 5×105 cells/well in a 96-well cell culture plate. Three-fold serial dilutions of either IL-7 or an IL-7Rα ligand (BGL21) were added to the cells and incubated for 3 days at 37° C. After the treatment, cells were incubated in viability dye (Live/Dead® Fixable Aqua Cell Stain Kit, ThermoFisher #L34965) for 30 min at 37° C., after which surface antibody staining was then performed in PBS+2% FBS for 30 min on ice. Cells were fixed and permeabilized with Fixation/Permeabilization Buffer (eBioscience Foxp3/Transcription Staining Buffer Set, ThermoFisher #00-5523-00) for 30 min on ice. Intracellular (Ki-67) staining was performed in Permeabilization Buffer for 30 min on ice and the treated cells resuspended in PBS+2% FBS prior to FACS analysis. NK cells were identified as CD56+ and/or CD159a+ cells from CD3− and CD20− (non-T, non-B cell) populations. Antibody conjugates used for cell surface and intracellular staining are shown in Table 7.

Representative phage clones displaying peptides from certain IL-7Rα ligand families were bound to the extracellular domain (ECD) of the IL-7Rα subunit immobilized in microtiter wells. Phage binding was conducted in the presence and absence of synthetic test peptides to determine whether the phage peptides and the test peptides competed for binding to the same site on the IL-7Rα subunit. Synthetic test peptides were selected to represent IL-7Rα ligands from different IL-7Rα ligand families, as well as to provide positive and negative control peptides.

The IL-7Rα ligand families and the specific IL-7Rα ligands within those families that were evaluated are provided in Table 8.

TABLE 8

IL-7Rα ligand families and specific IL-7Rα ligands.

| IL-7Rα Ligand Family | Specific IL-7Rα SEQ ID NO: | Peptide Sequence |
| --- | --- | --- |
| 1 | 146 | Q C V H W D L D T L F G C I R E Q L E L |
| 1 | 5 | Q C I H W D I E T L L S C V |
| 2 | 458 | G G V P W C T L D P G S L Q C A W F |
| 3A | 43 | V Y C A E I G E Y R V C R Q |
| 3B | 104 | Y M A C S S G L S L C R L S |
| N/A | 429 | V V C Q D W E G V E L C W Q |

The IL-7Rα ligands can bind to the hIL-7Rα subunit with an $IC_{50}$ of less than 10 µM and with an $IC_{50}$ to an irrelevant cytokine receptor such as the Rγc subunit of greater than 100 µM.

TABLE 7

| Antibody conjugates used for cell surface and intracellular staining | | | | | | | | |
| --- | --- | --- | --- | --- | --- | --- | --- | --- |
| Marker | CD3 | Ki-67 | CD56 | CD20 | CD45RA | CD8 | CD159a | Live/Dead |
| Fluor | FITC | PE | PerCP-eFluor710 | PE-Cy7 | APC | BV421 | BV650 | Aqua |
| Clone | UCHT1 | SolA15 | CMSSB | 2H7 | HI100 | SK1 | 131411 | — |
| Vendor | Invitrogen | Invitrogen | Invitrogen | BioLegend | BD | BioLegend | BD | Invitrogen |
| Cat no. | CD0301 | 12-2698-82 | 46-0567-42 | 302312 | 550855 | 344748 | 747920 | L349650 |

IL-7Rα/Rγc Ligand A and the hIgG2-Fc construct having SEQ ID NO: 427 exhibited an $EC_{50}$ of less than 10 µM as determined using the Ki-67 proliferation assay in CD4 and CD8 T-cells. hIL-7 exhibited an $EC_{50}$ of about 1 nM as determined using the Ki-67 proliferation assay in CD4 and CD8 T-cells.

Example 11

Unique IL-7Rα Binding Site

Competitive binding assays were performed to characterize the binding site for IL-7Rα ligands on the IL-7Rα subunit.

Phage binding to the immobilized IL-7Rα ECD was detected by staining with antibody against phage coat proteins (anti-phage Ab), staining with labeled secondary antibody against the anti-phage Ab, and scored by reading OD in the microtiter plate optical reader.

The ELISA signal for each phage binding in the presence and absence of the test peptides was compared to determine which synthetic peptides competed with which phage peptides for binding to the IL-7Rα subunit. The peptide pairs that exhibited competitive binding (i.e., cross inhibition) were considered to bind at the same functional site on the IL-7 receptor. The results are presented in Table 9.

TABLE 9

Competition for IL-7Rα binding to the IL-7Rα subunit among sequence families of IL-7Rα ligands.

| | | Phage Clone SEQ ID NO | | | | |
|---|---|---|---|---|---|---|
| IL-7Rα Ligand SEQ ID NO: | IL-7Rα Ligand IL-7Rα Ligand Family | 5 1 | 458 2 | 43 3A | 104 3B | 429 N/A |
| 146 | 1 | + [1] | + | + | + | 0 [2] |
| 5 | 1 | + | + | + | + | − [3] |
| 458 | 2 | + | + | + | + | − |
| 43 | 3A | + | + | + | + | − |
| 104 | 3B | + | + | + | + | − |
| 429 [4] | N/A | 0 | 0 | 0 | 0 | 0 |

[1] IL-7Rα ligand competes with phage binding.
[2] IL-7Rα ligand does not compete with phage binding.
[3] Not tested.
[4] Negative control.

The IL-7Rα ligands did not bind competitively to the binding site of the IL-7Rα subunit with IL-7.

Table 9 shows that IL-7Rα ligands representing ligand Families 1, 2, 3A, and 3B compete among themselves for binding to the hIL-7Rα subunit and therefore bind at or near the same site on the hIL-7Rα subunit.

Example 12

Competitive Binding of IL-7Rα Ligands

A competition binding assay was used to characterize the IL-7Rα binding site of an IL-7Rα ligand comprising SEQ ID NOS: 520-534 or 554. The IL-7Rα ligands comprising SEQ ID NOS: 520-534 including a peptide having the amino acid sequence with two glycines (-GG-) on the carboxyl terminus or SEQ ID NO: 554.

The competition binding ELISA is described in Example 7. In this example, bn407::NA-HRP precomplexes were made using C-terminal biotinylated forms of the IL-7Rα ligands.

The IC$_{50}$ (M) for the ligands is presented in Table 10.

TABLE 10

Competitive binding assay.

| IL-7Rα Ligand | Competitive Binding ELISA bn407: NA-HRP (10 nMf) IC$_{50}$ M |
|---|---|
| SEQ ID NO: 520 | 7.05E-7 |
| SEQ ID NO: 521 | 7.58E-6 |
| SEQ ID NO: 522 | 9.03E-7 |
| SEQ ID NO: 523 | 6.64E-7 |
| SEQ ID NO: 524 | 1.52E-6 |
| SEQ ID NO: 525 | 1.85E-6 |
| SEQ ID NO: 526 | 3.78E-7 |
| SEQ ID NO: 527 | 4.11E-7 |
| SEQ ID NO: 528 | 4.90E-7 |
| SEQ ID NO: 529 | 4.66E-7 |
| SEQ ID NO: 530 | 6.82E-7 |
| SEQ ID NO: 531 | 5.21E-7 |
| SEQ ID NO: 532 | 9.42E-7 |
| SEQ ID NO: 533 | 1.07E-6 |
| SEQ ID NO: 534 | 6.02E-7 |
| SEQ ID NO: 554 | 3.82E-7 |

ASPECTS OF THE INVENTION

The invention is further defined by the following aspects.

Aspect 1. An IL-7Rα ligand, wherein the IL-7Rα ligand binds to the human IL-7Rα subunit with an IC$_{50}$ of less than 100 μM.

Aspect 2. The IL-7Rα ligand of aspect 1, wherein the IL-7Rα ligand binds to the human IL-7Rα subunit with an IC$_{50}$ from 1 pM to 100 μM.

Aspect 3. The IL-7Rα ligand of any one of aspects 1 to 2, wherein the IL-7Rα ligand comprises the amino acid sequence of Formula (1) (SEQ ID NO: 1) or a partial amino acid sequence of Formula (1) such as the amino acid sequence of Formula (1a) (SEQ ID NO: 2), or the amino acid sequence of Formula (1b) (SEQ ID NO: 3):

$$-X^1-C-X^2-X^3-X^4-X^5-X^6-X^7-X^8-X^9-X^{10}-X^{11}-C-X^{12}- \quad (1)$$

$$-C-X^2-X^3-X^4-X^5-X^6-X^7-X^8-X^9-X^{10}-X^{11}-C- \quad (1a)$$

$$-X^2-X^3-X^4-X^5-X^6-X^7-X^8-X^9-X^{10}-X^{11} \quad (1b)$$

wherein.
$X^1$ is selected from an amino acid comprising a small hydrophobic side chain;
$X^2$ is selected from an amino acid comprising a polar/neutral side chain and an amino acid comprising a large hydrophobic side chain;
$X^3$ is selected from an amino acid comprising a large hydrophobic side chain;
$X^4$ is selected from an amino acid comprising a large hydrophobic side chain;
$X^5$ is selected from an amino acid comprising an acidic side chain;
$X^6$ is selected from an amino acid comprising a large hydrophobic side chain;
$X^7$ is selected from an amino acid comprising an acidic side chain;
$X^8$ is selected from an amino acid comprising a small hydrophobic side chain;
$X^9$ is an amino acid comprising a large hydrophobic side chain;
$X^{10}$ is an amino acid comprising a large hydrophobic side chain;
$X^{11}$ is selected from an amino acid comprising a small hydrophobic side chain and an amino acid comprising a large hydrophobic side chain; and
$X^{12}$ is selected from an amino acid.

Aspect 4. The IL-7Rα ligand of aspect 3, wherein $X^1$ is selected from P, Q, S, T, and Y.

Aspect 5. The IL-7Rα ligand of any one of aspects 3 to 4, wherein $X^2$ is selected from F, I, P, Q, and S.

Aspect 6. The IL-7Rα ligand of any one of aspects 3 to 5, wherein $X^3$ is selected from H and V.

Aspect 7. The IL-7Rα ligand of any one of aspects 3 to 5, wherein $X^3$ is H.

Aspect 8. The IL-7Rα ligand of any one of aspects 3 to 7, wherein $X^4$ is selected from H, Q, W, and Y.

Aspect 9. The IL-7Rα ligand of any one of aspects 3 to 7, wherein $X^4$ is W.

Aspect 10. The IL-7Rα ligand of any one of aspects 3 to 9, wherein $X^5$ is selected from D and P.

Aspect 11. The IL-7Rα ligand of any one of aspects 3 to 9, wherein $X^5$ is D.

Aspect 12. The IL-7Rα ligand of any one of aspects 3 to 10, wherein $X^6$ is selected from E, I, L, and V.

Aspect 13. The IL-7Rα ligand of any one of aspects 3 to 10, wherein $X^6$ is L.

Aspect 14. The IL-7Rα ligand of any one of aspects 3 to 13, wherein, $X^7$ is selected from D, E, and Q.

Aspect 15. The IL-7Rα ligand of any one of aspects 3 to 13, wherein $X^7$ is E.

Aspect 16. The IL-7Rα ligand of any one of aspects 3 to 15, wherein $X^8$ is selected from D, G, S, and T.

Aspect 17. The IL-7Rα ligand of any one of aspects 3 to 15, wherein $X^8$ is T.

Aspect 18. The IL-7Rα ligand of any one of aspects 3 to 17, wherein $X^9$ is L.

Aspect 19. The IL-7Rα ligand of any one of aspects 3 to 18, wherein $X^{10}$ is selected from A, M, and L.

Aspect 20. The IL-7Rα ligand of any one of aspects 3 to 18, wherein $X^{10}$ is L.

Aspect 21. The IL-7Rα ligand of any one of aspects 3 to 20, wherein $X^{11}$ is selected from A, S and V.

Aspect 22. The IL-7Rα ligand of any one of aspects 3 to 20, wherein $X^{11}$ is selected from S and V.

Aspect 23. The IL-7Rα ligand of any one of aspects 3 to 21, wherein $X^{12}$ is selected from A, I, R, T, and V.

Aspect 24. The IL-7Rα ligand of aspect 3, wherein,
$X^1$ is selected from P, Q, S, T, and Y;
$X^2$ is selected from F, I, P, Q, and S;
$X^3$ is selected from H and V;
$X^4$ is selected from H, Q, W, and Y;
$X^5$ is selected from D and P;
$X^6$ is selected from E, I, L, and V;
$X^7$ is selected from D, E, and Q;
$X^8$ is selected from D, G, S, and T;
$X^9$ is L;
$X^{10}$ is selected from A, M, and L;
$X^{11}$ is selected from A, S, and V; and
$X^{12}$ is selected from A, I, R, T, and V.

Aspect 25. The IL-7Rα ligand of aspect 3, wherein,
$X^1$ is selected from P, Q, S, T, and Y;
$X^2$ is selected from F, I, P, Q, and S;
$X^3$ is H;
$X^4$ is W;
$X^5$ is D;
$X^6$ is L;
$X^7$ is E;
$X^8$ is T;
$X^9$ is L;
$X^{10}$ is L;
$X^{11}$ is selected from S and V; and
$X^{12}$ is selected from A, I, R, T, and V.

Aspect 26. The IL-7Rα ligand of aspect 3, wherein,
$X^1$ is selected from an amino acid;
$X^2$ is selected from an amino acid;
$X^3$ is H;
$X^4$ is selected from an amino acid comprising an aromatic side chain;
$X^5$ is D;
$X^6$ is selected from an amino acid comprising a large hydrophobic side chain;
$X^7$ is selected from D and E;
$X^8$ is selected from an amino acid;
$X^9$ is L;
$X^{10}$ is selected from L and M;
$X^{11}$ is selected from an amino acid; and
$X^{12}$ is selected from an amino acid.

Aspect 27. The IL-7Rα ligand of aspect 3, wherein the IL-7Rα ligand comprises an amino acid sequence selected from any one of SEQ ID NOS: 4-8.

Aspect 28. The IL-7Rα ligand of aspect 27, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 4-8.

Aspect 29. The IL-7Rα ligand of any one of aspects 2 to 3, wherein the IL-7Rα ligand comprises an amino acid sequence of Formula (2) (SEQ ID NO: 9) or a partial amino acid sequence of Formula (2) such as an amino acid sequence of Formula (2a) (SEQ ID NO: 10), an amino acid sequence of Formula (2b) (SEQ ID NO: 11), an amino acid sequence of Formula (2c) (SEQ ID NO: 12), or an amino acid sequence of Formula (2d) (SEQ ID NO: 13):

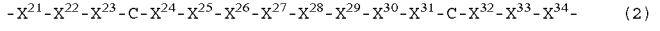
$$-X^{21}-X^{22}-X^{23}-C-X^{24}-X^{25}-X^{26}-X^{27}-X^{28}-X^{29}-X^{30}-X^{31}-C-X^{32}-X^{33}-X^{34}- \quad (2)$$

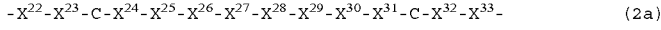
$$-X^{22}-X^{23}-C-X^{24}-X^{25}-X^{26}-X^{27}-X^{28}-X^{29}-X^{30}-X^{31}-C-X^{32}-X^{33}- \quad (2a)$$

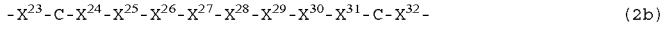
$$-X^{23}-C-X^{24}-X^{25}-X^{26}-X^{27}-X^{28}-X^{29}-X^{30}-X^{31}-C-X^{32}- \quad (2b)$$

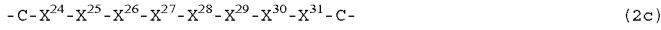
$$-C-X^{24}-X^{25}-X^{26}-X^{27}-X^{28}-X^{29}-X^{30}-X^{31}-C- \quad (2c)$$

$$-X^{24}-X^{25}-X^{26}-X^{27}-X^{28}-X^{29}-X^{30}-X^{31} \quad (2d)$$

wherein,
$X^{21}$ is selected from an amino acid comprising a large hydrophobic side chain;
$X^{22}$ is selected from an amino acid comprising an acidic side chain, an amino acid comprising a small hydrophobic side chain, and an amino acid comprising a large hydrophobic side chain;
$X^{23}$ is selected from an amino acid comprising a large hydrophobic side chain;
$X^{24}$ is selected from an amino acid;
$X^{25}$ is selected from an amino acid comprising an acidic side chain and an amino acid comprising a large hydrophobic side chain;
$X^{26}$ is selected from an amino acid comprising an acidic side chain and an amino acid comprising a large hydrophobic side chain;

X²⁷ is P;
X²⁸ is G;
X²⁹ is selected from an amino acid comprising a small hydrophobic side chain and an amino acid comprising a large hydrophobic side chain;
X³⁰ is selected from an amino acid comprising a small hydrophobic side chain and an amino acid comprising a large hydrophobic side chain;
X³¹ is selected from an amino acid comprising an acidic side chain, an amino acid comprising a polar/neutral side chain, and an amino acid comprising a large hydrophobic side chain;
X³² is selected from an amino acid;
X³³ is selected from an amino acid comprising a polar/neutral side chain and an amino acid comprising an aromatic side chain; and
X³⁴ is selected from an amino acid comprising a polar/neutral side chain and an amino acid comprising a large hydrophobic side chain.

Aspect 30. The IL-7Rα ligand of aspect 29, wherein X²¹ is selected from D, I, R, S, V, and Y.

Aspect 31. The IL-7Rα ligand of any one of aspects 29 to 30, wherein X²¹ is selected from D and V.

Aspect 32. The IL-7Rα ligand of any one of aspects 29 to 31, wherein X²² is selected from D, E, P, W, and Y.

Aspect 33. The IL-7Rα ligand of any one of aspects 29 to 31, wherein X²² is selected from P, W, and Y.

Aspect 34. The IL-7Rα ligand of any one of aspects 29 to 33, wherein X²³ is selected from A, E, L, S, and W.

Aspect 35. The IL-7Rα ligand of any one of aspects 29 to 33, wherein X²³ is selected from L and W.

Aspect 36. The IL-7Rα ligand of any one of aspects 29 to 35, wherein X²⁴ is selected from A, D, R, S, T, and Y.

Aspect 37. The IL-7Rα ligand of any one of aspects 29 to 35, wherein X²⁴ is selected from D, R, and T.

Aspect 38. The IL-7Rα ligand of any one of aspects 29 to 37, wherein X²⁵ is selected from D, E, L, M, P, and T.

Aspect 39. The IL-7Rα ligand of any one of aspects 29 to 37, wherein X²⁵ is L.

Aspect 40. The IL-7Rα ligand of any one of aspects 29 to 39, wherein X²⁶ is selected from A, D, G, L, N, V, and W.

Aspect 41. The IL-7Rα ligand of any one of aspects 29 to 39, wherein X²⁶ is D.

Aspect 42. The IL-7Rα ligand of any one of aspects 29 to 41, wherein X²⁷ is P.

Aspect 43. The IL-7Rα ligand of any one of aspects 29 to 42, wherein X²⁸ is G.

Aspect 44. The IL-7Rα ligand of any one of aspects 29 to 43, wherein X²⁹ is selected from D, G, L, S, T, W, and Y.

Aspect 45. The IL-7Rα ligand of any one of aspects 29 to 43, wherein X²⁹ is selected from G and S.

Aspect 46. The IL-7Rα ligand of any one of aspects 29 to 45, wherein X³⁰ is selected from A, D, F, L, P, T, and V.

Aspect 47. The IL-7Rα ligand of any one of aspects 29 to 45, wherein X³⁰ is L.

Aspect 48. The IL-7Rα ligand of any one of aspects 29 to 47, wherein X³¹ is selected from D, E, F, H, Q, R, V, and Y.

Aspect 49. The IL-7Rα ligand of any one of aspects 29 to 47, wherein X³¹ is Q.

Aspect 50. The IL-7Rα ligand of any one of aspects 29 to 49, wherein X³² is selected from A, E, L, Q, S, and V.

Aspect 51. The IL-7Rα ligand of any one of aspects 29 to 49, wherein X³² is selected from A and V.

Aspect 52. The IL-7Rα ligand of any one of aspects 29 to 51, wherein X³³ is selected from D, F, H, I, S, T, V, and W.

Aspect 53. The IL-7Rα ligand of any one of aspects 29 to 51, wherein X³³ is W.

Aspect 54. The IL-7Rα ligand of any one of aspects 29 to 53, wherein X³⁴ is selected from F, I, L, M, Q, R, S, and T.

Aspect 55. The IL-7Rα ligand of any one of aspects 29 to 53, wherein X³⁴ is F.

Aspect 56. The IL-7Rα ligand of aspect 29, wherein,
X²¹ is selected from I and V;
X²² is selected from P, W, and Y;
X²³ is selected from L and W;
X²⁴ is selected from an amino acid;
X²⁵ is selected from L and M;
X²⁶ is D;
X²⁷ is P;
X²⁸ is G;
X²⁹ is an amino acid;
X³⁰ is selected from F, L, and V;
X³¹ is an amino acid;
X³² is an amino acid;
X³³ is selected from F, H, and W; and
X³⁴ is selected from F, I, L, and M.

Aspect 57. The IL-7Rα ligand of aspect 29, wherein,
X²¹ V;
X²² is P;
X²³ is W;
X²⁴ is selected from an amino acid;
X²⁵ is L;
X²⁶ is D;
X²⁷ is P;
X²⁸ is G;
X²⁹ is an amino acid;
X³⁰ is selected from F, I, L, M, V, Y, and W;
X³¹ is an amino acid;
X³² is an amino acid;
X³³ is selected from F, H, W, and Y; and
X³⁴ is selected from F, I, L, M, V, Y, and W.

Aspect 58. The IL-7Rα ligand of aspect 29, wherein the IL-7Rα ligand comprises an amino acid sequence selected from any one of SEQ ID NOS: 14-21.

Aspect 59. The IL-7Rα ligand of aspect 29, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 14-21.

Aspect 60. The IL-7Rα ligand of any one of aspects 1 to 2, wherein the IL-7Rα ligand comprises an amino acid sequence of Formula (3) (SEQ ID NO: 22) or a partial amino acid sequence of Formula (3) such as the amino acid sequence of Formula (3a) (SEQ ID NO: 23), the amino acid sequence of Formula (3b) (SEQ ID NO: 24), the amino acid sequence of Formula (3c) (SEQ ID NO: 25), or the amino acid sequence of Formula (3d) (SEQ ID NO: 26):

$$-X^{41}-X^{42}-X^{43}-C-X^{44}-X^{45}-X^{46}-X^{47}-X^{48}-X^{49}-X^{50}-X^{51}-C-X^{52}-X^{53}- \quad (3)$$

$$-X^{42}-X^{43}-C-X^{44}-X^{45}-X^{46}-X^{47}-X^{48}-X^{49}-X^{50}-X^{51}-C-X^{52}-X^{53}- \quad (3a)$$

$$-X^{43}-C-X^{44}-X^{45}-X^{46}-X^{47}-X^{48}-X^{49}-X^{50}-X^{51}-C-X^{52} \quad (3b)$$

$$-C-X^{44}-X^{45}-X^{46}-X^{47}-X^{48}-X^{49}-X^{50}-X^{51}-C- \quad (3c)$$

$$-X^{44}-X^{45}-X^{46}-X^{47}-X^{48}-X^{49}-X^{50}-X^{51} \quad (3d)$$

wherein,
- $X^{41}$ is selected from an amino acid comprising a large hydrophobic side chain;
- $X^{42}$ is selected from an amino acid comprising a large hydrophobic side chain;
- $X^{43}$ is selected from an amino acid comprising a small hydrophobic side chain and an amino acid comprising a large hydrophobic side chain;
- $X^{44}$ is selected from an amino acid comprising an acidic side chain, an amino acid comprising a hydroxyl side chain, and an amino acid comprising a large hydrophobic side chain;
- $X^{45}$ is selected from an amino acid comprising a large hydrophobic side chain;
- $X^{46}$ is selected from an amino acid comprising a small hydrophobic side chain, an amino acid comprising an acidic side chain, an amino acid comprising a polar/neutral side chain, and an amino acid comprising a basic side chain;
- $X^{47}$ is selected from an amino acid comprising a small hydrophobic side chain or an amino acid comprising a polar/neutral side chain;
- $X^{48}$ is selected from an amino acid comprising polar/neutral side chain and an amino acid comprising a large hydrophobic side chain;
- $X^{49}$ is selected from an amino acid comprising a basic side chain;
- $X^{50}$ is selected from an amino acid comprising a large hydrophobic side chain;
- $X^{51}$ is selected from an amino acid comprising a basic side chain;
- $X^{52}$ is selected from an amino acid comprising a small hydrophobic side chain; and
- $X^{53}$ is selected from an amino acid comprising a polar/neutral side chain and an amino acid comprising a large hydrophobic side chain.

Aspect 61. The IL-7Rα ligand of aspect 61, wherein $X^{41}$ is L.

Aspect 62. The IL-7Rα ligand of any one of aspects 60 to 61, wherein $X^{42}$ is selected from I, L, and V.

Aspect 63. The IL-7Rα ligand of any one of aspects 60 to 62, wherein $X^{43}$ is selected from A, C, D, E, F, H, Q, and Y.

Aspect 64. The IL-7Rα ligand of any one of aspects 60 to 62, wherein $X^{43}$ is selected from F, Q, and Y.

Aspect 65. The IL-7Rα ligand of any one of aspects 60 to 64, wherein $X^{44}$ is selected from A, I, M, Q, T, and V.

Aspect 66. The IL-7Rα ligand of any one of aspects 60 to 64, wherein $X^{45}$ is selected from D, E, F, H, I, N, S, T, V, and Y.

Aspect 67. The IL-7Rα ligand of any one of aspects 60 to 64, wherein $X^{45}$ is selected from E, T, and V.

Aspect 68. The IL-7Rα ligand of any one of aspects 60 to 67, wherein $X^{46}$ is selected from F, I, L, and W.

Aspect 69. The IL-7Rα ligand of any one of aspects 60 to 67, wherein $X^{46}$ is selected from F and I.

Aspect 70. The IL-7Rα ligand of any one of aspects 60 to 69, wherein $X^{47}$ is selected from A, D, E, G, H, K, L, R, and S.

Aspect 71. The IL-7Rα ligand of any one of aspects 60 to 69, wherein $X^{47}$ is selected from G, H, and P.

Aspect 72. The IL-7Rα ligand of any one of aspects 60 to 71, wherein $X^{48}$ is selected from A, E, G, N, P, Q, S, T, and V.

Aspect 73. The IL-7Rα ligand of any one of aspects 60 to 71, wherein $X^{48}$ is selected from G and N.

Aspect 74. The IL-7Rα ligand of any one of aspects 60 to 73, wherein $X^{49}$ is selected from F, G, I, Q, T, V, and Y.

Aspect 75. The IL-7Rα ligand of any one of aspects 60 to 73, wherein $X^{49}$ is selected from G, Q, and Y.

Aspect 76. The IL-7Rα ligand of any one of aspects 60 to 75, wherein $X^{50}$ is selected from K and R.

Aspect 77. The IL-7Rα ligand of any one of aspects 60 to 76, wherein $X^{51}$ is selected from I, L, and V.

Aspect 78. The IL-7Rα ligand of any one of aspects 60 to 76, wherein $X^{51}$ is selected from L and V.

Aspect 79. The IL-7Rα ligand of any one of aspects 60 to 78, wherein $X^{52}$ is R.

Aspect 80. The IL-7Rα ligand of any one of aspects 60 to 79, wherein $X^{53}$ is selected from A, G, L, Q, S, and T.

Aspect 81. The IL-7Rα ligand of any one of aspects 60 to 79, wherein $X^{53}$ is selected from A, S, and T.

Aspect 82. The IL-7Rα ligand of aspect 60, wherein,
- $X^{41}$ is L;
- $X^{42}$ is selected from I, L, and V;
- $X^{43}$ is selected from A, C, D, E, F, H, Q, and Y;
- $X^{43}$ is selected from F, Q, and Y;
- $X^{44}$ is selected from A, I, M, Q, T, and V;
- $X^{45}$ is selected from D, E, F, H, I, N, S, T, V, and Y;
- $X^{45}$ is selected from E, T, and V;
- $X^{46}$ is selected from F, I, L, and W;
- $X^{46}$ is selected from F and I;
- $X^{47}$ is selected from A, D, E, G, H, K, L, P, R, and S;
- $X^{47}$ is selected from G, H, and P;
- $X^{48}$ is selected from A, E, G, N, P, Q, S, T, and V;
- $X^{48}$ is selected from G and N;
- $X^{49}$ is selected from F, G, I, Q, T, V, and Y;
- $X^{49}$ is selected from G, Q, and Y;
- $X^{50}$ is selected from K and R;
- $X^{51}$ is selected from I, L, and V;
- $X^{51}$ is selected from L and V;
- $X^{52}$ is R;
- $X^{53}$ is selected from A, G, L, Q, S, and T; and
- $X^{53}$ is selected from A, S, and T.

Aspect 83. The IL-7Rα ligand of aspect 60, wherein,
- $X^{41}$ is L;
- $X^{42}$ is selected from I, L, and V;
- $X^{43}$ is selected from F, Q, and Y;
- $X^{44}$ is selected from A, I, M, Q, T, and V;
- $X^{45}$ is selected from E, T, and V;
- $X^{46}$ is selected from F and I;
- $X^{47}$ is selected from G, H, and P;
- $X^{48}$ is selected from G and N;
- $X^{49}$ is selected from G, Q, and Y;
- $X^{50}$ is selected from K and R;
- $X^{51}$ is selected from L and V;
- $X^{52}$ is R; and
- $X^{53}$ is selected from A, S, and T.

Aspect 84. The IL-7Rα ligand of aspect 60, wherein,
- $X^{41}$ is L;
- $X^{42}$ is selected from an amino acid comprising a large hydrophobic side chain;
- $X^{43}$ is Y;

$X^{44}$ is selected from an amino acid comprising a large hydrophobic side chain;
$X^{45}$ is selected from an amino acid comprising a large hydrophobic side chain;
$X^{46}$ is F;
$X^{47}$ is H;
$X^{48}$ is G;
$X^{49}$ is Y;
$X^{50}$ is K;
$X^{51}$ is V;
$X^{52}$ is R; and
$X^{53}$ is S.

Aspect 85. The IL-7Rα ligand of aspect 60, wherein the IL-7Rα ligand comprises an amino acid sequence selected from any one of SEQ ID NOS: 27-49.

Aspect 86. The IL-7Rα ligand of aspect 60, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 27-49.

Aspect 87. The IL-7Rα ligand of any one of aspects 1 and 2, wherein the IL-7Rα ligand comprises an amino acid sequence of Formula (4) (SEQ ID NO: 50) or a partial amino acid sequence of Formula (4) such as the amino acid sequence of Formula (4a) (SEQ ID NO: 51), the amino acid sequence of Formula (4b) (SEQ ID NO: 52), the amino acid sequence of Formula (4c) (SEQ ID NO: 53), the amino acid sequence of Formula (4d) (SEQ ID NO: 54), or the amino acid sequence of Formula (4e) (SEQ ID NO: 55):

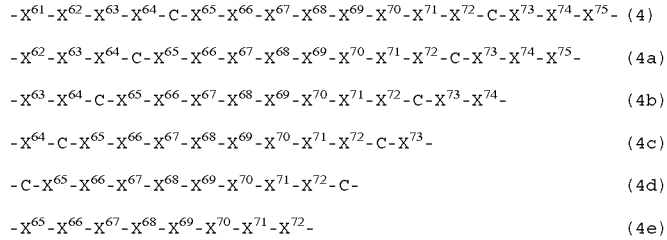

wherein,
$X^{61}$ is an amino acid comprising a large hydrophobic side chain;
$X^{62}$ is selected from an amino acid comprising a small hydrophobic side chain and an amino acid comprising a polar/neutral side chain;
$X^{63}$ is an amino acid comprising a large hydrophobic side chain;
$X^{64}$ is an amino acid comprising a large hydrophobic side chain;
$X^{65}$ is selected from an amino acid comprising a large hydrophobic side chain;
$X^{66}$ is selected from an amino acid comprising a basic side chain and an amino acid comprising a polar/neutral side chain;
$X^{67}$ is selected from an amino acid comprising a large hydrophobic side chain;
$X^{68}$ is selected from an amino acid comprising a small hydrophobic side chain;
$X^{69}$ is selected from an amino acid comprising a small hydrophobic side chain;
$X^{70}$ is selected from an amino acid;
$X^{71}$ is selected from an amino acid comprising a basic side chain and an amino acid comprising a large hydrophobic side chain;
$X^{72}$ is selected from an amino acid comprising a large hydrophobic side chain;
$X^{73}$ is selected from an amino acid comprising a basic side chain;
$X^{74}$ is selected from an amino acid comprising a small hydrophobic side chain; and
$X^{75}$ is selected from an amino acid comprising a polar/neutral side chain.

Aspect 88. The IL-7Rα ligand of aspect 87, wherein $X^{61}$ is V.

Aspect 89. The IL-7Rα ligand of any one of aspects 87 to 88, wherein $X^{62}$ is selected from G, H, N, P, Q, R, S, and V.

Aspect 90. The IL-7Rα ligand of any one of aspects 87 to 89, wherein $X^{62}$ is P.

Aspect 91. The IL-7Rα ligand of any one of aspects 87 to 90, wherein $X^{63}$ is selected from C, I, and V.

Aspect 92. The IL-7Rα ligand of any one of aspects 87 to 90, wherein $X^{63}$ is V.

Aspect 93. The IL-7Rα ligand of any one of aspects 87 to 92, wherein $X^{64}$ is selected from A, F, V, and Y.

Aspect 94. The IL-7Rα ligand of any one of aspects 87 to 92, wherein $X^{64}$ is Y.

Aspect 95. The IL-7Rα ligand of any one of aspects 87 to 94, wherein $X^{65}$ is selected from A, I, L, M, N, and V.

Aspect 96. The IL-7Rα ligand of any one of aspects 87 to 95, wherein $X^{66}$ is selected from E, H, K, L, N, Q, R, and T.

Aspect 97. The IL-7Rα ligand of any one of aspects 87 to 96, wherein $X^{67}$ is selected from F, G, L, and P.

Aspect 98. The IL-7Rα ligand of any one of aspects 87 to 96, wherein $X^{67}$ is L.

Aspect 99. The IL-7Rα ligand of any one of aspects 87 to 98, wherein $X^{68}$ is selected from G and P.

Aspect 100. The IL-7Rα ligand of any one of aspects 87 to 98, wherein $X^{68}$ is P.

Aspect 101. The IL-7Rα ligand of any one of aspects 87 to 100, wherein $X^{69}$ is selected from G and I.

Aspect 102. The IL-7Rα ligand of any one of aspects 87 to 100, wherein $X^{69}$ is G.

Aspect 103. The IL-7Rα ligand of any one of aspects 87 to 102, wherein $X^{70}$ is selected from G, H, Q, S, T, and Y.

Aspect 104. The IL-7Rα ligand of any one of aspects 87 to 103, wherein $X^{71}$ is selected from K, R, V, and Y.

Aspect 105. The IL-7Rα ligand of any one of aspects 87 to 104, wherein $X^{72}$ is selected from N, P, and V.

Aspect 106. The IL-7Rα ligand of any one of aspects 87 to 104, wherein $X^{72}$ is V.

Aspect 107. The IL-7Rα ligand of any one of aspects 87 to 106, wherein $X^{73}$ is R.

Aspect 108. The IL-7Rα ligand of any one of aspects 87 to 107, wherein $X^{74}$ is selected from A, G, L, N, S, and V.

Aspect 109. The IL-7Rα ligand of any one of aspects 87 to 107, wherein $X^{74}$ is S.

Aspect 110. The IL-7Rα ligand of any one of aspects 87 to 109, wherein $X^{75}$ is selected from H, L, R, S, T, and Y.

Aspect 111. The IL-7Rα ligand of aspect 87, wherein,
$X^{61}$ is V;
$X^{62}$ is selected from G, H, N, P, Q, R, S, and V;
$X^{63}$ is selected from C, I, and V;
$X^{64}$ is selected from A, F, V, and Y;
$X^{65}$ is selected from A, I, L, M, N, and V;
$X^{66}$ is selected from E, H, K, L, N, Q, R, and T;
$X^{67}$ is selected from F, G, L, and P;
$X^{68}$ is selected from G and P;
$X^{69}$ is selected from G and I;
$X^{70}$ is selected from G, H, Q, S, T, and Y;
$X^{71}$ is selected from K, R, V, and Y;
$X^{72}$ is selected from N, P, and V;
$X^{73}$ is R;
$X^{74}$ is selected from A, G, L, N, S, and V; and
$X^{75}$ is selected from H, L, R, S, T, and Y.

Aspect 112. The IL-7Rα ligand of aspect 87, wherein,
$X^{61}$ is V;
$X^{62}$ is P;
$X^{63}$ is V;
$X^{64}$ is Y;
$X^{65}$ is selected from A, I, L, M, N, and V;
$X^{66}$ is selected from E, H, K, L, N, Q, R, and T;
$X^{67}$ is L;
$X^{68}$ is P;
$X^{69}$ is G;
$X^{70}$ is selected from G, H, Q, S, T, and Y;
$X^{71}$ is selected from K, R, V, and Y;
$X^{72}$ is selected from N, P, and V;
$X^{72}$ is V;
$X^{73}$ is R;
$X^{74}$ is S; and
$X^{75}$ is selected from H, L, R, S, T, and Y.

Aspect 113. The IL-7Rα ligand of aspect 87, wherein,
$X^{61}$ is V;
$X^{62}$ is P;
$X^{63}$ is V;
$X^{64}$ is Y;
$X^{65}$ is selected from an amino acid comprising a large hydrophobic side chain;
$X^{66}$ is selected from an amino acid;
$X^{67}$ is L;
$X^{68}$ is P;
$X^{69}$ is G;
$X^{70}$ is selected from an amino acid;
$X^{71}$ is selected from an amino acid comprising a basic side chain;
$X^{72}$ is V;
$X^{73}$ is R;
$X^{74}$ is S; and
$X^{75}$ is selected from an amino acid comprising a hydroxyl-containing side chain.

Aspect 114. The IL-7Rα ligand of aspect 87, wherein IL-7Rα ligand comprises an amino acid sequence selected from any one of SEQ ID NOS: 56-73.

Aspect 115. The IL-7Rα ligand of aspect 87, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 56-73.

Aspect 116. The IL-7Rα ligand of any one of aspects 1 and 2, wherein the IL-7Rα ligand comprises an amino acid sequence of Formula (5) (SEQ ID NO: 74) or a partial amino acid sequence of Formula (5) such as the amino acid sequence of Formula (5a) (SEQ ID NO: 75), the amino acid sequence of Formula (5b) (SEQ ID NO: 76), or the amino acid sequence of Formula (5c) (SEQ ID NO: 77):

$$-X^{81}-X^{82}-X^{83}-X^{84}-X^{85}-X^{86}-X^{87}-X^{88}-X^{89}-X^{90}-X^{91}-X^{92}-X^{93}-X^{94}-X^{95}- \quad (5)$$

$$-X^{82}-X^{83}-X^{84}-X^{85}-X^{86}-X^{87}-X^{88}-X^{89}-X^{90}-X^{91}-X^{92}-X^{93}-X^{94}- \quad (5a)$$

$$-X^{83}-X^{84}-X^{85}-X^{86}-X^{87}-X^{88}-X^{89}-X^{90}-X^{91}-X^{92}-X^{93}- \quad (5b)$$

$$-X^{84}-X^{85}-X^{86}-X^{87}-X^{88}-X^{89}-X^{90}-X^{91}-X^{92}- \quad (5c)$$

wherein,
$X^{81}$ is selected from C, K, R, S, and V;
$X^{82}$ is selected from C and S;
$X^{83}$ is selected from K, L, R, and S;
$X^{84}$ is selected from G, H, R, S, and T;
$X^{85}$ is selected from G, R, T, V, and W;
$X^{86}$ is selected from D, F, P, and R;
$X^{87}$ is selected from L, M, and W;
$X^{88}$ is selected from D, E, and V;
$X^{89}$ is selected from L, N, P, and S;
$X^{90}$ is selected from D, F, L, and W;
$X^{91}$ is selected from L, N, and W;
$X^{92}$ is selected from G, I, L, and Q;
$X^{93}$ is selected from C, F, N, and S;
$X^{94}$ is selected from C, I and R; and
$X^{95}$ is selected from L and N.

Aspect 117. The IL-7Rα ligand of aspect 116, wherein IL-7Rα ligand comprises an amino acid sequence selected from any one of SEQ ID NOS: 78-82.

Aspect 118. The IL-7Rα ligand of aspect 116, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 78-82.

Aspect 119. The IL-7Rα ligand of any one of aspects 1 and 2, wherein the IL-7Rα ligand comprises an amino acid sequence selected from any one of SEQ ID NOS: 83-105.

Aspect 120. The IL-7Rα ligand of aspect 119, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 83-105.

Aspect 121. The IL-7Rα ligand of any one of aspects 1 and 2, wherein the IL-7Rα ligand comprises an amino acid sequence of Formula (6) (SEQ ID NO: 106) or a partial amino acid sequence of Formula (6) such as the amino acid sequence of Formula (6a) (SEQ ID NO: 107), the amino acid sequence of Formula (6b) (SEQ ID NO: 108), the amino acid sequence of Formula (6c) (SEQ ID NO: 109), the amino acid sequence of Formula (6d) (SEQ ID NO: 110), the amino acid sequence of Formula (6e) (SEQ ID NO: 111):

$-X^{101}-X^{102}-X^{103}-X^{104}-X^{105}-X^{106}-X^{107}-C-X^{108}-X^{109}-X^{110}-X^{111}-X^{112}-X^{113}-X^{114}-X^{115}-X^{116}-X^{117}-C-X^{118}-$ (6)

$X^{119}-X^{120}-X^{121}-X^{122}-X^{123}-X^{124}-X^{125}-X^{126}-$ $-X^{105}-X^{106}-X^{107}-C-X^{108}-X^{109}-X^{110}-X^{111}-X^{112}-X^{113}-X^{114}-X^{115}-X^{116}-X^{117}-C-X^{118}-X^{119}-X^{120}-$ (6a)

$-X^{106}-X^{107}-C-X^{108}-X^{109}-X^{110}-X^{111}-X^{112}-X^{113}-X^{114}-X^{115}-X^{116}-X^{117}-C-X^{118}-X^{119}-$ (6b)

$-X^{107}-C-X^{108}-X^{109}-X^{110}-X^{111}-X^{112}-X^{113}-X^{114}-X^{115}-X^{116}-X^{117}-C-X^{118}-$ (6c)

$-C-X^{108}-X^{109}-X^{110}-X^{111}-X^{112}-X^{113}-X^{114}-X^{115}-X^{116}-X^{117}-C-$ (6d)

$-X^{108}-X^{109}-X^{110}-X^{111}-X^{112}-X^{113}-X^{114}-X^{115}-X^{116}-X^{117}-$ (6e)

wherein,
$X^{101}$ is selected from an amino acid comprising a small hydrophobic side chain;
$X^{102}$ is selected from an amino acid;
$X^{103}$ is selected from an amino acid comprising a polar/neutral side chain;
$X^{104}$ is selected from an amino acid comprising a polar neutral side chain and an amino acid comprising a basic side chain;
$X^{105}$ is selected from an amino acid comprising a small hydrophobic side chain;
$X^{106}$ is selected from an amino acid comprising a small hydrophobic side chain;
$X^{107}$ is selected from an amino acid comprising a polar/neutral hydrophobic side chain, and amino acid comprising an acidic side chain, and an amino acid comprising an aromatic side chain;
$X^{108}$ is selected from an amino acid comprising a large hydrophobic side chain;
$X^{109}$ is selected from an amino acid comprising a basic side chain;
$X^{110}$ is selected from an amino acid comprising a large hydrophobic side chain;
$X^{111}$ is selected from an amino acid comprising an acidic side chain;
$X^{112}$ is selected from an amino acid comprising a large hydrophobic side chain;
$X^{113}$ is selected from an amino acid comprising an acidic side chain;
$X^{114}$ is selected from an amino acid comprising a hydroxyl-containing side chain;
$X^{115}$ is selected from an amino acid comprising a large hydrophobic side chain;
$X^{116}$ is selected from an amino acid comprising a large hydrophobic side chain;
$X^{117}$ is selected from an amino acid comprising a small hydrophobic side chain;
$X^{118}$ is selected from an amino acid comprising a large hydrophobic side chain;
$X^{119}$ is selected from an amino acid comprising an acidic side chain, an amino acid comprising a polar/neutral side chain, and an amino acid comprising a basic side chain;
$X^{120}$ is selected from an amino acid;
$X^{121}$ is selected from an amino acid;
$X^{122}$ is selected from an amino acid;
$X^{123}$ is selected from an amino acid;
$X^{124}$ is selected from an amino acid;
$X^{125}$ is selected from an amino acid; and
$X^{126}$ is selected from an amino acid.

Aspect 122. The IL-7Rα ligand of aspect 121, wherein $X^{101}$ is selected from E, G, I, Q, R, S, and T.

Aspect 123. The IL-7Rα ligand of any one of aspects 121 to 122, wherein $X^{102}$ is selected from A, D, G, H, M, R, S, V, and W.

Aspect 124. The IL-7Rα ligand of any one of aspects 121 to 123, wherein $X^{103}$ is selected from F, G, K, L, Q, S, and Y.

Aspect 125. The IL-7Rα ligand of any one of aspects 121 to 124, wherein $X^{104}$ is selected from I, K, M, N, P, Q, R, S, T, and V.

Aspect 126. The IL-7Rα ligand of any one of aspects 121 to 125, wherein $X^{105}$ is selected from F, G, K, L, M, Q, R, S, T, and W.

Aspect 127. The IL-7Rα ligand of any one of aspects 121 to 125, wherein $X^{105}$ is G.

Aspect 128. The IL-7Rα ligand of any one of aspects 121 to 127, wherein $X^{106}$ is selected from A, D, E, F, G, I, K, L, M, R, S, T, and Y.

Aspect 129. The IL-7Rα ligand of any one of aspects 121 to 127, wherein $X^{106}$ is G.

Aspect 130. The IL-7Rα ligand of any one of aspects 121 to 129, wherein $X^{107}$ is selected from D, E, F, G, H, N, P, Q, R, and Y.

Aspect 131. The IL-7Rα ligand of any one of aspects 121 to 129, wherein $X^{107}$ is selected from H, Q, and Y.

Aspect 132. The IL-7Rα ligand of any one of aspects 121 to 131, wherein $X^{108}$ is selected from A, F, I, K, L, M, N, P, S, T, V, and Y.

Aspect 133. The IL-7Rα ligand of any one of aspects 121 to 132, wherein $X^{109}$ is selected from G, H, K, and S.

Aspect 134. The IL-7Rα ligand of any one of aspects 121 to 132, wherein $X^{109}$ is H.

Aspect 135. The IL-7Rα ligand of any one of aspects 121 to 134, wherein $X^{110}$ is selected from F, I, K, L, S, and W.

Aspect 136. The IL-7Rα ligand of any one of aspects 121 to 134, wherein $X^{110}$ is W.

Aspect 137. The IL-7Rα ligand of any one of aspects 121 to 136, wherein $X^{111}$ is selected from D, E, and P.

Aspect 138. The IL-7Rα ligand of any one of aspects 121 to 136, wherein $X^{111}$ is D.

Aspect 139. The IL-7Rα ligand of any one of aspects 121 to 138, wherein $X^{112}$ is selected from I, F, L, and M.

Aspect 140. The IL-7Rα ligand of any one of aspects 121 to 138, wherein $X^{112}$ is L.

Aspect 141. The IL-7Rα ligand of any one of aspects 121 to 140, wherein $X^{113}$ is selected from D, E, G, Q, T, and Y.

Aspect 142. The IL-7Rα ligand of any one of aspects 121 to 140, wherein $X^{113}$ is E.

Aspect 143. The IL-7Rα ligand of any one of aspects 121 to 142, wherein $X^{114}$ is selected from Q, S, and T.

Aspect 144. The IL-7Rα ligand of any one of aspects 121 to 142, wherein $X^{114}$ is S.

Aspect 145. The IL-7Rα ligand of any one of aspects 121 to 144, wherein $X^{115}$ is selected from L, F, and S.

Aspect 146. The IL-7Rα ligand of any one of aspects 121 to 144, wherein $X^{115}$ is L.

Aspect 147. The IL-7Rα ligand of any one of aspects 121 to 146, wherein $X^{116}$ is selected from F, I, L, M, N, V, and W.

Aspect 148. The IL-7Rα ligand of any one of aspects 121 to 146, wherein $X^{116}$ is L.

Aspect 149. The IL-7Rα ligand of any one of aspects 121 to 148, wherein $X^{117}$ is selected from A, D, E, F, G, H, L, M, N, Q, R, S, W, and Y.

Aspect 150. The IL-7Rα ligand of any one of aspects 121 to 148, wherein $X^{117}$ is selected from A and S.

Aspect 151. The IL-7Rα ligand of any one of aspects 121 to 150, wherein $X^{118}$ is selected from F, I, K, L, M, Q, R, and V.

Aspect 152. The IL-7Rα ligand of any one of aspects 121 to 150, wherein $X^{118}$ is V.

Aspect 153. The IL-7Rα ligand of any one of aspects 121 to 152, wherein $X^{119}$ is selected from A, D, E, G, H, K, M, N, Q, R, S, and Y.

Aspect 154. The IL-7Rα ligand of any one of aspects 121 to 152, wherein $X^{119}$ is R.

Aspect 155. The IL-7Rα ligand of any one of aspects 121 to 154, wherein $X^{120}$ is selected from A, D, E, G, I, K, M, N, P, Q, R, S, T, and Y.

Aspect 156. The IL-7Rα ligand of any one of aspects 121 to 155, wherein $X^{121}$ is selected from A, E, G, H, I, K, L, N, P, Q, R, S, and W.

Aspect 157. The IL-7Rα ligand of any one of aspects 121 to 156, wherein $X^{122}$ is selected from A, E, F, I, K, L, P, R, S, and T.

Aspect 158. The IL-7Rα ligand of any one of aspects 121 to 157, wherein $X^{123}$ is selected from D, E, F, G, I, L, M, N, R, W, and Y.

Aspect 159. The IL-7Rα ligand of any one of aspects 121 to 158, wherein $X^{124}$ is selected from A, E, G, H, K, L, P, Q, R, S, T, and Y.

Aspect 160. The IL-7Rα ligand of any one of aspects 121 to 159, wherein $X^{125}$ is E.

Aspect 161. The IL-7Rα ligand of any one of aspects 121 to 160, wherein $X^{126}$ is A.

Aspect 162. The IL-7Rα ligand of aspect 121, wherein,
$X^{101}$ is selected from E, G, I, Q, R, S, and T;
$X^{102}$ is selected from A, D, G, H, M, R, S, V, and W;
$X^{103}$ is selected from F, G, K, L, Q, S, and Y;
$X^{104}$ is selected from I, K, M, N, P, Q, R, S, T, and V;
$X^{105}$ is selected from F, G, K, L, M, Q, R, S, T, and W;
$X^{106}$ is selected from A, D, E, F, G, I, K, L, M, R, S, T, and Y;
$X^{107}$ is selected from D, E, F, G, H, N, P, Q, R, and Y;
$X^{108}$ is selected from A, F, I, K, L, M, N, P, S, T, V, and Y;
$X^{109}$ is selected from G, H, K, and S;
$X^{110}$ is selected from F, I, K, L, S, and W;
$X^{111}$ is selected from D, E, and P;
$X^{112}$ is selected from I, F, L, and M;
$X^{113}$ is selected from D, E, G, Q, T, and Y;
$X^{114}$ is selected from Q, S, and T;
$X^{115}$ is selected from F, L, and S;
$X^{116}$ is selected from F, I, L, M, N, V, and W;
$X^{117}$ is selected from A, D, E, F, G, H, L, M, N, Q, R, S, W, and Y;
$X^{118}$ is selected from F, I, K, L, M, Q, R, and V;
$X^{119}$ is selected from A, D, E, G, H, K, M, N, Q, R, S, and Y;
$X^{120}$ is selected from A, D, E, G, I, K, M, N, P, Q, R, S, T, and Y;
$X^{121}$ is selected from A, E, G, H, I, K, L, N, P, Q, R, S, and W;
$X^{122}$ is selected from A, E, F, I, K, L, P, R, S, and T;
$X^{123}$ is selected from D, E, F, G, I, L, M, N, R, W, and Y;
$X^{124}$ is selected from A, E, G, H, K, L, P, Q, R, S, T, and Y;
$X^{125}$ is E; and
$X^{126}$ is A.

Aspect 163. The IL-7Rα ligand of aspect 121, wherein,
$X^{101}$ is selected from E, G, I, Q, R, S, and T;
$X^{102}$ is selected from A, D, G, H, M, R, S, V, and W;
$X^{103}$ is selected from F, G, K, L, Q, S, and Y;
$X^{104}$ is selected from I, K, M, N, P, Q, R, S, T, and V;
$X^{105}$ is G;
$X^{106}$ is G;
$X^{107}$ is selected from H, Q, and Y;
$X^{108}$ is selected from A, F, I, K, L, M, N, P, S, T, V, and Y;
$X^{109}$ is H;
$X^{110}$ is W;
$X^{111}$ is D;
$X^{112}$ is L;
$X^{113}$ is E;
$X^{114}$ is S;
$X^{115}$ is L;
$X^{116}$ is L;
$X^{117}$ is selected from A and S;
$X^{118}$ is V;
$X^{119}$ is R;
$X^{120}$ is selected from A, D, E, G, I, K, M, N, P, Q, R, S, T, and Y;
$X^{121}$ is selected from A, E, G, H, I, K, L, N, P, Q, R, S, and W;
$X^{122}$ is selected from A, E, F, I, K, L, P, R, S, and T;
$X^{123}$ is selected from D, E, F, G, I, L, M, N, R, W, and Y;
$X^{124}$ is selected from A, E, G, H, K, L, P, Q, R, S, T, and Y;
$X^{125}$ is E; and
$X^{126}$ is A.

Aspect 164. The IL-7Rα ligand of aspect 121, wherein,
$X^{107}$ is selected from an amino acid comprising a large hydrophobic side chain;
$X^{108}$ is selected from an amino acid comprising a basic side chain;
$X^{109}$ is selected from H and K;
$X^{110}$ is W;
$X^{111}$ is D;
$X^{112}$ is selected from I, L, and M;
$X^{113}$ is selected from D and E;
$X^{114}$ is selected from S and T;
$X^{115}$ is selected from F and L;
$X^{116}$ is selected from F, L, and M;
$X^{117}$ is selected from A and S; and
$X^{118}$ is selected from I and V.

Aspect 165. The IL-7Rα ligand of aspect 121, wherein,
$X^{107}$ is selected from H, Q and Y;
$X^{108}$ is selected from A, F, I, K, L, M, N, P, S, T, V, and Y;
$X^{109}$ is selected from H and K;
$X^{110}$ is W;
$X^{111}$ is D;
$X^{112}$ is selected from I, L, and M;
$X^{113}$ is selected from D and E;
$X^{114}$ is selected from S and T;
$X^{115}$ is selected from F and L;
$X^{116}$ is selected from F, L, and M;
$X^{117}$ is selected from A and S; and $X^{118}$ is selected from I and V.

Aspect 166. The IL-7Rα ligand of aspect 121, wherein,
$X^{107}$ is selected from H, Q, and Y;
$X^{108}$ is selected from A, F, I, K, L, M, N, P, S, T, V, and Y;
$X^{109}$ is H;
$X^{110}$ is W;
$X^{111}$ is D;
$X^{112}$ is L;
$X^{113}$ is E;
$X^{114}$ is S;
$X^{115}$ is L;
$X^{116}$ is L;
$X^{117}$ is selected from A and S; and
$X^{118}$ is V.

Aspect 167. The IL-7Rα ligand of aspect 121, wherein the IL-7Rα ligand comprises an amino acid sequence selected from any one of SEQ ID NOS: 112-183.

Aspect 168. The IL-7Rα ligand of aspect 121, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 112-183.

Aspect 169. The IL-7Rα ligand of any one of aspects 1 and 2, wherein the IL-7Rα ligand comprises an amino acid sequence of Formula (7) (SEQ ID NO: 184) or a partial amino acid sequence of Formula (7) such as the amino acid sequence of Formula (7a) (SEQ ID NO: 185), the amino acid sequence of Formula (7b) (SEQ ID NO: 186), the amino acid sequence of Formula (7c) (SEQ ID NO: 187), the amino acid sequence of Formula (7d) (SEQ ID NO: 188), or the amino acid sequence of Formula (7e) (SEQ ID NO: 189):

$$-X^{131}-X^{132}-X^{133}-X^{134}-X^{135}-X^{136}-X^{137}-X^{138}-X^{139}-C-X^{140}-X^{141}-X^{142}-X^{143}-X^{144}-X^{145}-X^{146}-X^{147}-C-X^{148}- \quad (7)$$
$$X^{149}-X^{150}-X^{151}-X^{152}-X^{153}-X^{154}-X^{155}-X^{156}-$$

$$-X^{137}-X^{138}-X^{139}-C-X^{140}-X^{141}-X^{142}-X^{143}-X^{144}-X^{145}-X^{146}-X^{147}-C-X^{148}-X^{149}-X^{150}- \quad (7a)$$

$$-X^{138}-X^{139}-C-X^{140}-X^{141}-X^{142}-X^{143}-X^{144}-X^{145}-X^{146}-X^{147}-C-X^{148}-X^{149}- \quad (7b)$$

$$-X^{139}-C-X^{140}-X^{141}-X^{142}-X^{143}-X^{144}-X^{145}-X^{146}-X^{147}-C-X^{148}- \quad (7c)$$

$$-C-X^{140}-X^{141}-X^{142}-X^{143}-X^{144}-X^{145}-X^{146}-X^{147}-C- \quad (7d)$$

$$-X^{140}-X^{141}-X^{142}-X^{143}-X^{144}-X^{145}-X^{146}-X^{147}- \quad (7e)$$

wherein,
$X^{131}$ is selected from an amino acid;
$X^{132}$ is selected from an amino acid;
$X^{133}$ is selected from an amino acid;
$X^{134}$ is selected from an amino acid;
$X^{135}$ is selected from an amino acid;
$X^{136}$ is selected from an amino acid;
$X^{137}$ is selected from an amino acid comprising a large hydrophobic side chain;
$X^{138}$ is selected from an amino acid comprising a small hydrophobic side chain;
$X^{139}$ is selected from an amino acid comprising a large hydrophobic side chain;
$X^{140}$ is selected from an amino acid comprising a large hydrophobic side chain and an amino acid comprising a small hydrophobic side chain;
$X^{141}$ is selected from an amino acid comprising a large hydrophobic side chain;
$X^{142}$ is selected from an amino acid comprising an acidic side chain;
$X^{143}$ is selected from an amino acid comprising a small hydrophobic side chain;
$X^{144}$ is selected from an amino acid comprising a small hydrophobic side chain;
$X^{145}$ is selected from an amino acid comprising a small hydrophobic side chain;
$X^{146}$ is selected from an amino acid comprising a large hydrophobic side chain;
$X^{147}$ is selected from an amino acid comprising a polar/neutral side chain;
$X^{148}$ is selected from an amino acid comprising a small hydrophobic side chain;
$X^{149}$ is selected from an amino acid comprising an aromatic side chain;
$X^{150}$ is selected from an amino acid comprising a large hydrophobic side chain;
$X^{151}$ is selected from an amino acid comprising a polar/neutral side chain;
$X^{152}$ is selected from an amino acid comprising a polar/neutral side chain;
$X^{153}$ is selected from an amino acid comprising an acidic side chain and an amino acid comprising a polar/neutral side chain;
$X^{154}$ is selected from an amino acid;
$X^{155}$ is selected from an amino acid; and
$X^{156}$ is selected from an amino acid.

Aspect 170. The IL-7Rα ligand of aspect 169, wherein $X^{131}$ is selected from D, E, G, H, I, K, M, N, Q, R, S, T, V, W, and Y.

Aspect 171. The IL-7Rα ligand of any one of aspects 169 to 170, wherein $X^{131}$ is G.

Aspect 172. The IL-7Rα ligand of any one of aspects 169 to 171, wherein $X^{132}$ is selected from A, C, D, E, F, G, H, K, N, P, Q, R, S, T, V, and W.

Aspect 173. The IL-7Rα ligand of any one of aspects 169 to 172, wherein $X^{133}$ is selected from E, F, G, H, I, K, L, M, N, Q, R, S, and W.

Aspect 174. The IL-7Rα ligand of any one of aspects 169 to 173, wherein $X^{134}$ is selected from A, D, E, F, G, H, I, K, L, M, N, Q, R, S, T, V, W, and Y.

Aspect 175. The IL-7Rα ligand of any one of aspects 169 to 173, wherein $X^{134}$ is selected from D, E, G, R, S, T, and W.

Aspect 176. The IL-7Rα ligand of any one of aspects 169 to 173, wherein $X^{134}$ is G.

Aspect 177. The IL-7Rα ligand of any one of aspects 169 to 176, wherein $X^{135}$ is selected from A, C, D, E, F, G, H, I, K, L, M, N, Q, R, S, T, V, and W.

Aspect 178. The IL-7Rα ligand of any one of aspects 169 to 176, wherein $X^{135}$ is selected from G, R, S, and T.

Aspect 179. The IL-7Rα ligand of any one of aspects 169 to 178, wherein $X^{136}$ is selected from A, D, E, F, G, H, I, K, L, M, P, Q, R, S, T, V, and Y.

Aspect 180. The IL-7Rα ligand of any one of aspects 169 to 178, wherein $X^{136}$ is selected from G, R, S, T, and V.

Aspect 181. The IL-7Rα ligand of any one of aspects 169 to 178, wherein $X^{136}$ is G.

Aspect 182. The IL-7Rα ligand of any one of aspects 169 to 181, wherein $X^{137}$ is selected from D, I, L, and V.

Aspect 183. The IL-7Rα ligand of any one of aspects 169 to 181, wherein $X^{137}$ is selected from I and V.

Aspect 184. The IL-7Rα ligand of any one of aspects 169 to 183, wherein $X^{138}$ is selected from D, F, N, P, and R.

Aspect 185. The IL-7Rα ligand of any one of aspects 169 to 183, wherein $X^{138}$ is P.

Aspect 186. The IL-7Rα ligand of any one of aspects 169 to 185, wherein $X^{139}$ is selected from G, S, and W.

Aspect 187. The IL-7Rα ligand of any one of aspects 169 to 185, wherein $X^{139}$ is W.

Aspect 188. The IL-7Rα ligand of any one of aspects 169 to 187, wherein $X^{140}$ is selected from A, D, E, H, I, K, L, M, N, Q, R, S, T, and V.

Aspect 189. The IL-7Rα ligand of any one of aspects 169 to 187, wherein $X^{140}$ is selected from L, M, S, and T.

Aspect 190. The IL-7Rα ligand of any one of aspects 169 to 187, wherein $X^{140}$ is T.

Aspect 191. The IL-7Rα ligand of any one of aspects 169 to 190, wherein $X^{141}$ is selected from D, L, and W.

Aspect 192. The IL-7Rα ligand of any one of aspects 169 to 190, wherein $X^{141}$ is L.

Aspect 193. The IL-7Rα ligand of any one of aspects 169 to 192, wherein $X^{142}$ is selected from A, D, H, Q, and W.

Aspect 194. The IL-7Rα ligand of any one of aspects 169 to 192, wherein $X^{142}$ is D.

Aspect 195. The IL-7Rα ligand of any one of aspects 169 to 194, wherein $X^{143}$ is P.

Aspect 196. The IL-7Rα ligand of any one of aspects 169 to 195, wherein $X^{144}$ is selected from A, G, and S.

Aspect 197. The IL-7Rα ligand of any one of aspects 169 to 196, wherein $X^{145}$ is S.

Aspect 198. The IL-7Rα ligand of any one of aspects 169 to 197, wherein $X^{146}$ is selected from F, I, L, M, Q, V, and Y.

Aspect 199. The IL-7Rα ligand of any one of aspects 169 to 197, wherein $X^{146}$ is L.

Aspect 200. The IL-7Rα ligand of any one of aspects 169 to 199, wherein $X^{147}$ is selected from H, Q, and R.

Aspect 201. The IL-7Rα ligand of any one of aspects 169 to 199, wherein $X^{147}$ is Q.

Aspect 202. The IL-7Rα ligand of any one of aspects 169 to 201, wherein $X^{148}$ is selected from A, D, E, G, H, K, L, M, Q, S, T, V, and W.

Aspect 203. The IL-7Rα ligand of any one of aspects 169 to 201, wherein $X^{148}$ is A.

Aspect 204. The IL-7Rα ligand of any one of aspects 169 to 203, wherein $X^{149}$ is selected from F, R, W, and Y.

Aspect 205. The IL-7Rα ligand of any one of aspects 169 to 203, wherein $X^{149}$ is W.

Aspect 206. The IL-7Rα ligand of any one of aspects 169 to 205, wherein $X^{150}$ is selected from F, I, L, M, Q, S, V, W, and Y.

Aspect 207. The IL-7Rα ligand of any one of aspects 169 to 205, wherein $X^{150}$ is L.

Aspect 208. The IL-7Rα ligand of any one of aspects 169 to 207, wherein $X^{151}$ is selected from A, E, G, H, K, L, M, N, Q, R, S, and V.

Aspect 209. The IL-7Rα ligand of any one of aspects 169 to 207, wherein $X^{151}$ is selected from R, S, and T.

Aspect 210. The IL-7Rα ligand of any one of aspects 169 to 209, wherein $X^{152}$ is selected from A, D, E, G, H, I, K, L, M, N, Q, R, T, and Y.

Aspect 211. The IL-7Rα ligand of any one of aspects 169 to 209, wherein $X^{152}$ is selected from G, K, N, R, and S.

Aspect 212. The IL-7Rα ligand of any one of aspects 169 to 211, wherein $X^{153}$ is selected from A, D, E, F, G, H, I, K, L, M, N, Q, R, S, T, V, W and Y.

Aspect 213. The IL-7Rα ligand of any one of aspects 169 to 212, wherein $X^{154}$ is selected from A, E, F, G, K, L, N, Q, R, V, W, and Y.

Aspect 214. The IL-7Rα ligand of any one of aspects 169 to 212, wherein $X^{154}$ is selected from E, G, and K.

Aspect 215. The IL-7Rα ligand of any one of aspects 169 to 214, wherein $X^{155}$ is selected from A, D, E, G, H, K, N, P, S, T, V, and W.

Aspect 216. The IL-7Rα ligand of any one of aspects 169 to 214, wherein $X^{155}$ is selected from E, K, and S.

Aspect 217. The IL-7Rα ligand of any one of aspects 169 to 216, wherein $X^{156}$ is selected from D, E, G, H, K, N, Q, R, S, V, and W.

Aspect 218. The IL-7Rα ligand of any one of aspects 169 to 216, wherein $X^{156}$ is selected from G, K, and R.

Aspect 219. The IL-7Rα ligand of aspect 169, wherein,
$X^{131}$ is selected from D, E, G, H, I, K, M, N, Q, R, S, T, V, W, and Y;
$X^{132}$ is selected from A, C, D, E, F, G, H, K, N, P, Q, R, S, T, V, and W;
$X^{133}$ is selected from E, F, G, H, I, K, L, M, N, Q, R, S, and W;
$X^{134}$ is selected from A, D, E, F, G, H, I, K, L, M, N, Q, R, S, T, V, W, and Y;
$X^{135}$ is selected from A, C, D, E, F, F, G, H, I, K, L, M, N, Q, R, S, T, V, and W;
$X^{136}$ is selected from A, D, E, F, G, H, I, K, L, M, P, Q, R, S, T, V, and Y;
$X^{137}$ is selected from D, I, L, and V;
$X^{138}$ is selected from D, F, N, P, and R;
$X^{139}$ is selected from G, S, and W;
$X^{140}$ is selected from A, D, E, H, I, K, L, M, N, Q, R, S, T, and V;
$X^{141}$ is selected from D, L, and W;
$X^{142}$ is selected from A, D, H, Q, and W;
$X^{143}$ is P;
$X^{144}$ is G;
$X^{145}$ is selected from A, G, and S;
$X^{146}$ is selected from F, I, L, M, Q, V, and Y;
$X^{147}$ is selected from H, Q, and R;
$X^{148}$ is selected from A, D, E, G, H, K, L, M, Q, S, T, V, and W;
$X^{149}$ is selected from F, R, W, and Y;
$X^{150}$ is selected from F, I, L, M, Q, S, V, W, and Y;
$X^{151}$ is selected from A, E, G, H, K, L, M, N, Q, R, S, T, and V;
$X^{152}$ is selected from A, D, E, G, H, I, K, L, M, N, Q, R, T, and Y;
$X^{153}$ is selected from A, D, E, F, G, H, I, K, L, M, N, Q, R, S, T, V, W, and Y;
$X^{154}$ is selected from A, E, F, G, K, L, N, Q, R, V, W, and Y;
$X^{155}$ is selected from A, D, E, G, H, K, N, P, S, T, V, and W; and
$X^{156}$ is selected from D, E, G, H, K, N, Q, R, S, V, and W.

Aspect 220. The IL-7Rα ligand of aspect 169, wherein,
$X^{131}$ is G;
$X^{132}$ is selected from A, C, D, E, F, G, H, K, N, P, Q, R, S, T, V, and W;
$X^{133}$ is selected from E, F, G, H, I, K, L, M, N, Q, R, S, and W;
$X^{134}$ is selected from D, E, G, R, S, T, and W;

$X^{135}$ is selected from G, R, S, and T;
$X^{136}$ is selected from G, R, S, T, and V;
$X^{137}$ is selected from I and V;
$X^{138}$ is P;
$X^{139}$ is W;
$X^{140}$ is selected from L, M, S, and T;
$X^{141}$ is L;
$X^{142}$ is D;
$X^{143}$ is P;
$X^{144}$ is G;
$X^{145}$ is S;
$X^{146}$ is L;
$X^{147}$ is Q;
$X^{148}$ is A;
$X^{149}$ is W;
$X^{150}$ is L;
$X^{151}$ is selected from R, S, and T;
$X^{152}$ is selected from G, K, N, R, and S;
$X^{153}$ is selected from A, D, E, F, G, H, I, K, L, M, N, Q, R, S, T, V, W, and Y;
$X^{154}$ is selected from E, G, and K;
$X^{155}$ is selected from E, K, and S; and
$X^{156}$ is selected from G, K, and R.

Aspect 221. The IL-7Rα ligand of aspect 169, wherein,
$X^{131}$ is G;
$X^{132}$ is selected from A, C, D, E, F, G, H, K, N, P, Q, R, S, T, V, and W;
$X^{133}$ is selected from E, F, G, H, I, K, L, M, N, Q, R, S, and W;
$X^{134}$ is G;
$X^{135}$ is selected from G, R, S, and T;
$X^{136}$ is G;
$X^{137}$ is selected from I and V;

Aspect 222. The IL-7Rα ligand of aspect 169, wherein,
$X^{137}$ is selected from I and V;
$X^{138}$ is P;
$X^{139}$ is W;
$X^{140}$ is T;
$X^{141}$ is L;
$X^{142}$ is D;
$X^{143}$ is P;
$X^{144}$ is G;
$X^{145}$ is S;
$X^{146}$ is L;
$X^{147}$ is Q;
$X^{148}$ is A;
$X^{149}$ is W; and
$X^{150}$ is L.

Aspect 223. The IL-7Rα ligand of aspect 169, wherein IL-7Rα ligand comprises an amino acid sequence selected from any one of SEQ ID NOS: 190349.

Aspect 224. The IL-7Rα ligand of aspect 169, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 190-349.

Aspect 225. The IL-7Rα ligand of any one of aspects 1 and 2, wherein the IL-7Rα ligand comprises an amino acid sequence of Formula (8) (SEQ ID NO: 350) or a partial amino acid sequence of Formula (8), such as the amino acid sequence of Formula (8a) (SEQ ID NO: 351), the amino acid sequence of Formula (8b) (SEQ ID NO: 352), the amino acid sequence of Formula (8c) (SEQ ID NO: 353), the amino acid sequence of Formula (8d) (SEQ ID NO: 354), or the amino acid sequence of Formula (8e) (SEQ ID NO: 355):

$$-X^{161}-X^{162}-X^{163}-X^{164}-X^{165}-X^{166}-C-X^{167}-X^{168}-X^{169}-X^{170}-X^{171}-X^{172}-X^{173}-X^{174}-C-X^{175}-X^{176}-X^{177}-X^{178}- \quad (8)$$
$$-X^{179}-X^{180}-$$

$$-X^{164}-X^{165}-X^{166}-C-X^{167}-X^{168}-X^{169}-X^{170}-X^{171}-X^{172}-X^{173}-X^{174}-C-X^{175}-X^{176}-X^{177}- \quad (8a)$$

$$-X^{165}-X^{166}-C-X^{167}-X^{168}-X^{169}-X^{170}-X^{171}-X^{172}-X^{173}-X^{174}-C-X^{175}-X^{176}- \quad (8b)$$

$$-X^{166}-C-X^{167}-X^{168}-X^{169}-X^{170}-X^{171}-X^{172}-X^{173}-X^{174}-C-X^{175}- \quad (8c)$$

$$-C-X^{167}-X^{168}-X^{169}-X^{170}-X^{171}-X^{172}-X^{173}-X^{174}-C- \quad (8d)$$

$$-X^{167}-X^{168}-X^{169}-X^{170}-X^{171}-X^{172}-X^{173}-X^{174}- \quad (8e)$$

$X^{138}$ is P;
$X^{139}$ is W;
$X^{140}$ is T;
$X^{141}$ is L;
$X^{142}$ is D;
$X^{143}$ is P;
$X^{144}$ is G;
$X^{145}$ is S;
$X^{146}$ is L;
$X^{147}$ is Q;
$X^{148}$ is A;
$X^{149}$ is W;
$X^{150}$ is L;
$X^{151}$ is selected from R, S, and T;
$X^{152}$ is selected from G, K, N, R, and S;
$X^{153}$ is selected from A, D, E, F, G, H, I, K, L, M, N, Q, R, S, T, V, W, and Y;
$X^{154}$ is selected from E, G, and K;
$X^{155}$ is selected from E, K, and S; and
$X^{156}$ is selected from G, K, and R.

wherein,
$X^{161}$ is selected from an amino acid;
$X^{162}$ is selected from an amino acid;
$X^{163}$ is selected from an amino acid;
$X^{164}$ is selected from an amino acid comprising a basic side chain;
$X^{165}$ is selected from an amino acid comprising a large hydrophobic side chain;
$X^{166}$ is selected from an amino acid comprising an acidic side chain or an amino acid comprising a large hydrophobic side chain;
$X^{167}$ is selected from an amino acid comprising a small hydrophobic side chain;
$X^{168}$ is selected from an amino acid comprising an acidic side chain;
$X^{169}$ is selected from an amino acid comprising a large hydrophobic side chain;
$X^{170}$ is selected from an amino acid comprising a small hydrophobic side chain;
$X^{171}$ is selected from an amino acid comprising a small hydrophobic side chain;

$X^{172}$ is selected from an amino acid comprising a small hydrophobic side chain;

$X^{173}$ is selected from an amino acid comprising a basic side chain or an amino acid comprising a large hydrophobic side chain;

$X^{174}$ is selected from an amino acid comprising a polar/neutral side chain or a large hydrophobic side chain;

$X^{175}$ is selected from an amino acid comprising a basic side chain;

$X^{176}$ is selected from an amino acid comprising a large hydrophobic side chain;

$X^{177}$ is selected from an amino acid comprising a basic side chain;

$X^{178}$ is selected from an amino acid;

$X^{179}$ is selected from an amino acid; and $X^{180}$ is selected from an amino acid.

Aspect 226. The IL-7Rα ligand of any one of aspect 225, wherein $X^{161}$ is selected from G, K, L, R, and T.

Aspect 227. The IL-7Rα ligand of any one of aspects 225 to 226, wherein $X^{161}$ is selected from G and R.

Aspect 228. The IL-7Rα ligand of any one of aspects 225 to 226, wherein $X^{161}$ is G.

Aspect 229. The IL-7Rα ligand of any one of aspects 225 to 227, wherein $X^{162}$ is selected from D, F, G, K, N, and R.

Aspect 230. The IL-7Rα ligand of any one of aspects 225 to 227, wherein $X^{162}$ is selected from G, K, N, and R.

Aspect 231. The IL-7Rα ligand of any one of aspects 225 to 230, wherein $X^{163}$ is selected from A, C, E, F, G, L, M, R, and V.

Aspect 232. The IL-7Rα ligand of any one of aspects 225 to 230, wherein $X^{163}$ is G.

Aspect 233. The IL-7Rα ligand of any one of aspects 225 to 232, wherein $X^{164}$ is R.

Aspect 234. The IL-7Rα ligand of any one of aspects 225 to 233, wherein $X^{165}$ is selected from I, L, Q, V, and Y.

Aspect 235. The IL-7Rα ligand of any one of aspects 225 to 233, wherein $X^{165}$ is selected from I, L, and V.

Aspect 236. The IL-7Rα ligand of any one of aspects 225 to 235, wherein $X^{166}$ is selected from D, E, and Y.

Aspect 237. The IL-7Rα ligand of any one of aspects 225 to 235, wherein $X^{166}$ is selected from E and Y.

Aspect 238. The IL-7Rα ligand of any one of aspects 225 to 237, wherein $X^{167}$ is selected from A, E, and Q.

Aspect 239. The IL-7Rα ligand of any one of aspects 225 to 237, wherein $X^{167}$ is A.

Aspect 240. The IL-7Rα ligand of any one of aspects 225 to 239, wherein $X^{168}$ is selected from D, E, K, N, Q, and S.

Aspect 241. The IL-7Rα ligand of any one of aspects 225 to 239, wherein $X^{168}$ is selected from D and E.

Aspect 242. The IL-7Rα ligand of any one of aspects 225 to 241, wherein $X^{169}$ is selected from F and L.

Aspect 243. The IL-7Rα ligand of any one of aspects 225 to 241, wherein $X^{169}$ is L.

Aspect 244. The IL-7Rα ligand of any one of aspects 225 to 243, wherein $X^{170}$ is P.

Aspect 245. The IL-7Rα ligand of any one of aspects 225 to 244, wherein $X^{171}$ is G.

Aspect 246. The IL-7Rα ligand of any one of aspects 225 to 245, wherein $X^{172}$ is G.

Aspect 247. The IL-7Rα ligand of any one of aspects 225 to 246, wherein $X^{173}$ is selected from F, H, K, L, Q, and R.

Aspect 248. The IL-7Rα ligand of any one of aspects 225 to 246, wherein $X^{173}$ is selected from F, L, and R.

Aspect 249. The IL-7Rα ligand of any one of aspects 225 to 248, wherein $X^{174}$ is selected from A, H, I, N, Q, T, and V.

Aspect 250. The IL-7Rα ligand of any one of aspects 225 to 248, wherein $X^{174}$ is selected from A, H, Q, and V.

Aspect 251. The IL-7Rα ligand of any one of aspects 225 to 248, wherein $X^{174}$ is V.

Aspect 252. The IL-7Rα ligand of any one of aspects 225 to 251, wherein $X^{175}$ is selected from E, K, and R.

Aspect 253. The IL-7Rα ligand of any one of aspects 225 to 252, wherein $X^{176}$ is selected from A, C, F, G, L, M, S, and V.

Aspect 254. The IL-7Rα ligand of any one of aspects 225 to 252, wherein $X^{176}$ is selected from L and S.

Aspect 255. The IL-7Rα ligand of any one of aspects 225 to 254, wherein $X^{176}$ is L.

Aspect 256. The IL-7Rα ligand of any one of aspects 225 to 255, wherein $X^{177}$ is selected from G, H, R, and W.

Aspect 257. The IL-7Rα ligand of any one of aspects 225 to 255, wherein $X^{177}$ is R.

Aspect 258. The IL-7Rα ligand of any one of aspects 225 to 257, wherein $X^{178}$ is selected from D, E, G, H, K, S, T, and V.

Aspect 259. The IL-7Rα ligand of any one of aspects 225 to 257, wherein $X^{178}$ is selected from E and S.

Aspect 260. The IL-7Rα ligand of any one of aspects 225 to 259, wherein $X^{179}$ is selected from A, D, E, M, Q, S, V, and W.

Aspect 261. The IL-7Rα ligand of any one of aspects 225 to 259, wherein $X^{179}$ is selected from A and S.

Aspect 262. The IL-7Rα ligand of any one of aspects 225 to 261, wherein $X^{180}$ is selected from D, E, G, I, L, M, R, and S.

Aspect 263. The IL-7Rα ligand of any one of aspects 225 to 261, wherein $X^{180}$ is selected from D and E.

Aspect 264. The IL-7Rα ligand of aspect 225, wherein,
$X^{161}$ is selected from G, K, L, R, and T;
$X^{162}$ is selected from D, F, G, K, N, and R;
$X^{163}$ is selected from A, C, E, F, G, L, M, R, and V;
$X^{164}$ is selected from H, I, L, P, Q, and R;
$X^{165}$ is selected from I, L, Q, V, and Y;
$X^{166}$ is selected from D, E, and Y;
$X^{167}$ is selected from A, E, and Q;
$X^{168}$ is selected from D, E, K, N, Q, and S;
$X^{169}$ is selected from F and L;
$X^{170}$ is P;
$X^{171}$ is G;
$X^{172}$ is G;
$X^{173}$ is selected from F, H, K, L, Q, and R;
$X^{174}$ is selected from A, H, I, N, Q, T, and V;
$X^{175}$ is selected from E, K, and R;
$X^{176}$ is selected from A, C, F, G, L, M, S, and V;
$X^{177}$ is selected from G, H, R, and W;
$X^{178}$ is selected from D, E, G, H, K, S, T, and V;
$X^{179}$ is selected from A, D, E, M, Q, S, V, and W; and
$X^{180}$ is selected from D, E, G, I, L, M, R, and S.

Aspect 265. The IL-7Rα ligand of aspect 225, wherein,
$X^{161}$ is selected from G and R;
$X^{162}$ is selected from G, K, N, and R;
$X^{163}$ is G;
$X^{164}$ is selected from H, I, L, P, Q, and R;
$X^{165}$ is selected from I, L, and V;
$X^{166}$ is selected from E and Y;
$X^{167}$ is A;
$X^{168}$ is selected from D and E;
$X^{169}$ is L;
$X^{170}$ is P;
$X^{171}$ is G;
$X^{172}$ is G;
$X^{173}$ is selected from F, L, and R;

$X^{174}$ is selected from A, H, Q, and V;
$X^{175}$ is selected from E, K, and R;
$X^{176}$ is selected from L and S;
$X^{177}$ is R;
$X^{178}$ is selected from E and S;
$X^{179}$ is selected from A and S; and
$X^{180}$ is selected from D and E.

Aspect 266. The IL-7Rα ligand of aspect 225, wherein,
$X^{161}$ is G;
$X^{162}$ is selected from G, K, N, and R;
$X^{163}$ is G;
$X^{164}$ is R;
$X^{165}$ is selected from I, L, and V;
$X^{166}$ is selected from E and Y;
$X^{167}$ is A;
$X^{168}$ is selected from D and E;
$X^{169}$ is L;
$X^{170}$ is P;
$X^{171}$ is G;
$X^{172}$ is G;
$X^{173}$ is selected from F, L, and R;
$X^{174}$ is V;
$X^{175}$ is selected from E, K, and R;
$X^{176}$ is L;
$X^{177}$ is R;
$X^{178}$ is selected from E and S;
$X^{179}$ is selected from A and S; and
$X^{180}$ is selected from D and E.

Aspect 267. The IL-7Rα ligand of aspect 225, wherein,
$X^{164}$ is R;
$X^{165}$ is selected from I, L, and V;
$X^{166}$ is selected from E and Y;
$X^{167}$ is A;
$X^{168}$ is selected from D and E;
$X^{169}$ is L;
$X^{170}$ is P;
$X^{171}$ is G;
$X^{172}$ is G;
$X^{173}$ is selected from F, L, and R;
$X^{174}$ is V;
$X^{175}$ is selected from E, K, and R;
$X^{176}$ is L; and
$X^{177}$ is R.

Aspect 268. The IL-7Rα ligand of aspect 225, wherein the IL-7Rα ligand comprises an amino acid sequence selected from any one of SEQ ID NOS: 356-388.

Aspect 269. The IL-7Rα ligand of aspect 225, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 356-388.

Aspect 270. The IL-7Rα ligand of any one of aspects 1 to 2, wherein the IL-7Rα ligand comprises an amino acid sequence of Formula (9) (SEQ ID NO: 389) or a partial amino acid sequence of Formula (9), such as an amino acid sequence of Formula (9a) (SEQ ID NO: 390), an amino acid sequence of Formula (9b) (SEQ ID NO: 391), or an amino acid sequence of Formula (9c) (SEQ ID NO: 392):

wherein,
$X^{201}$ is selected from an amino acid comprising a large hydrophobic side chain;
$X^{202}$ is selected from an amino acid comprising a small hydrophobic side chain or cysteine;
$X^{203}$ is selected from an amino acid comprising a large hydrophobic side chain;
$X^{204}$ is selected from an amino acid comprising a basic side chain or cysteine;
$X^{205}$ is selected from an amino acid comprising a large hydrophobic side chain or an amino acid comprising small hydrophobic side chain;
$X^{206}$ is selected from an amino acid comprising a large hydrophobic side chain or an amino acid comprising an acidic side chain;
$X^{207}$ is selected from an amino acid comprising an acidic side chain;
$X^{208}$ is selected from an amino acid comprising an acidic side chain or an amino acid comprising a small hydrophobic side chain;
$X^{209}$ is selected from an amino acid comprising a small hydrophobic side chain;
$X^{210}$ is selected from an amino acid comprising a large hydrophobic side chain or an amino acid comprising a small hydrophobic side chain;
$X^{211}$ is selected from an amino acid comprising a large hydrophobic side chain;
$X^{212}$ is selected from an amino acid comprising a polar/neutral side chain;
$X^{213}$ is selected from cysteine;
$X^{214}$ is selected from an amino acid comprising a small hydrophobic side chain or an amino acid comprising a large hydrophobic side chain;
$X^{215}$ is selected from an amino acid comprising a large hydrophobic side chain; and
$X^{216}$ is selected from an amino acid comprising a large hydrophobic side chain.

Aspect 271. The IL-7Rα ligand of aspect 270, wherein $X^{201}$ is selected from H, I, Q, and V.

Aspect 272. The IL-7Rα ligand of any one of aspects 270 to 271, wherein $X^{201}$ is selected from I, Q, and V.

Aspect 273. The IL-7Rα ligand of any one of aspects 270 to 271, wherein $X^{201}$ is I.

Aspect 274. The IL-7Rα ligand of any one of aspects 270 to 273, wherein $X^{202}$ is selected from C, P, and R.

Aspect 275. The IL-7Rα ligand of any one of aspects 270 to 273, wherein $X^{202}$ is selected from C and P.

Aspect 276. The IL-7Rα ligand of any one of aspects 270 to 275, wherein $X^{203}$ is selected from I, K, L, S, V, and W.

Aspect 277. The IL-7Rα ligand of any one of aspects 270 to 275, wherein $X^{203}$ is W.

Aspect 278. The IL-7Rα ligand of any one of aspects 270 to 277, wherein $X^{204}$ is selected from C and H.

Aspect 279. The IL-7Rα ligand of any one of aspects 270 to 278, wherein $X^{205}$ is selected from A, I, L, M, T, and W.

$-X^{201}-X^{202}-X^{203}-X^{204}-X^{205}-X^{206}-X^{207}-X^{208}-X^{209}-X^{210}-X^{211}-X^{212}-X^{213}-X^{214}-X^{215}-X^{216}-$ (9)

$-X^{202}-X^{203}-X^{204}-X^{205}-X^{206}-X^{207}-X^{208}-X^{209}-X^{210}-X^{211}-X^{212}-X^{213}-X^{214}-X^{215}-$ (9a)

$-X^{203}-X^{204}-X^{205}-X^{206}-X^{207}-X^{208}-X^{209}-X^{210}-X^{211}-X^{212}-X^{213}-X^{214}-$ (9b)

$-X^{204}-X^{205}-X^{206}-X^{207}-X^{208}-X^{209}-X^{210}-X^{211}-X^{212}-X^{213}-$ (9c)

Aspect 280. The IL-7Rα ligand of any one of aspects 270 to 278, wherein $X^{205}$ is selected from T and W.

Aspect 281. The IL-7Rα ligand of any one of aspects 270 to 280, wherein $X^{206}$ is selected from D, L, and W.

Aspect 282. The IL-7Rα ligand of any one of aspects 270 to 280, wherein $X^{206}$ is selected from D and L.

Aspect 283. The IL-7Rα ligand of any one of aspects 270 to 282, wherein $X^{207}$ is selected from D, I, L, and Q.

Aspect 284. The IL-7Rα ligand of any one of aspects 270 to 282, wherein $X^{207}$ is selected from D and L.

Aspect 285. The IL-7Rα ligand of any one of aspects 270 to 282, wherein $X^{207}$ is D.

Aspect 286. The IL-7Rα ligand of any one of aspects 270 to 285, wherein $X^{208}$ is selected from D, E, and P.

Aspect 287. The IL-7Rα ligand of any one of aspects 270 to 285, wherein $X^{208}$ is selected from E and P.

Aspect 288. The IL-7Rα ligand of any one of aspects 270 to 285, wherein $X^{208}$ is P.

Aspect 289. The IL-7Rα ligand of any one of aspects 270 to 288, wherein $X^{209}$ is selected from G, S, and T.

Aspect 290. The IL-7Rα ligand of any one of aspects 270 to 288, wherein $X^{209}$ is selected from G and S.

Aspect 291. The IL-7Rα ligand of any one of aspects 270 to 288, wherein $X^{209}$ is G.

Aspect 292. The IL-7Rα ligand of any one of aspects 270 to 291, wherein $X^{210}$ is selected from A, G, L, and S.

Aspect 293. The IL-7Rα ligand of any one of aspects 270 to 291, wherein $X^{210}$ is selected from L and S.

Aspect 294. The IL-7Rα ligand of any one of aspects 270 to 293, wherein $X^{211}$ is selected from F, I, L, and M.

Aspect 295. The IL-7Rα ligand of any one of aspects 270 to 293, wherein $X^{211}$ is L.

Aspect 296. The IL-7Rα ligand of any one of aspects 270 to 295, wherein $X^{212}$ is selected from G, H, L, N, Q, and S.

Aspect 297. The IL-7Rα ligand of any one of aspects 270 to 295, wherein $X^{212}$ is selected from Q and S.

Aspect 298. The IL-7Rα ligand of any one of aspects 270 to 295, wherein $X^{212}$ is Q.

Aspect 299. The IL-7Rα ligand of any one of aspects 270 to 298, wherein $X^{213}$ is C.

Aspect 300. The IL-7Rα ligand of any one of aspects 270 to 299, wherein $X^{214}$ is selected from A, E, I, L, S, T, and V.

Aspect 301. The IL-7Rα ligand of any one of aspects 270 to 299, wherein $X^{214}$ is selected from A and V.

Aspect 302. The IL-7Rα ligand of any one of aspects 270 to 301, wherein $X^{215}$ is selected from F, R, W, and Y.

Aspect 303. The IL-7Rα ligand of any one of aspects 270 to 301, wherein $X^{215}$ is W.

Aspect 304. The IL-7Rα ligand of any one of aspects 270 to 303, wherein $X^{216}$ is selected from E, L, Q, and W.

Aspect 305. The IL-7Rα ligand of any one of aspects 270 to 303, wherein $X^{216}$ is L.

Aspect 306. The IL-7Rα ligand of any one of aspects 270 to 303, wherein,
$X^{201}$ is selected from H, I, Q, and V;
$X^{202}$ is selected from C, P, and R;
$X^{203}$ is selected from I, K, L, S, V, and W;
$X^{204}$ is selected from C and H;
$X^{205}$ is selected from A, I, L, M, T, and W;
$X^{206}$ is selected from D, L, and W;
$X^{207}$ is selected from D, I, L, and Q;
$X^{208}$ is selected from D, E, and P;
$X^{209}$ is selected from G, S, and T;
$X^{210}$ is selected from A, G, L, and S;
$X^{211}$ is selected from F, I, L, and M;
$X^{212}$ is selected from G, H, L, N, Q, and S;
$X^{213}$ is C;
$X^{214}$ is selected from A, E, I, L, S, T, and V;
$X^{215}$ is selected from F, R, W, and Y; and
$X^{216}$ is selected from E, L, Q, and W.

Aspect 307. The IL-7Rα ligand of aspect 270, wherein,
$X^{201}$ is selected from I, Q, and V;
$X^{202}$ is selected from C and P;
$X^{203}$ is W;
$X^{204}$ is selected from C and H;
$X^{205}$ is selected from T and W;
$X^{206}$ is selected from D and L;
$X^{207}$ is selected from D and L;
$X^{208}$ is selected from E and P;
$X^{209}$ is selected from G and S;
$X^{210}$ is selected from L and S;
$X^{211}$ is L;
$X^{212}$ is selected from Q and S;
$X^{213}$ is C;
$X^{214}$ is selected from A and V; and
$X^{215}$ is W; and
$X^{216}$ is L.

Aspect 308. The IL-7Rα ligand of aspect 270, wherein,
$X^{201}$ is I;
$X^{202}$ is selected from C and P;
$X^{203}$ is W;
$X^{204}$ is selected from C and H;
$X^{205}$ is selected from T and W;
$X^{206}$ is selected from D and L;
$X^{207}$ is D;
$X^{208}$ is P;
$X^{209}$ is G;
$X^{210}$ is selected from L and S;
$X^{211}$ is L;
$X^{212}$ is Q;
$X^{213}$ is C;
$X^{214}$ is selected from A and V;
$X^{215}$ is W; and
$X^{216}$ is L.

Aspect 309. The IL-7Rα ligand of aspect 270, wherein,
$X^{201}$ is Q;
$X^{202}$ is C;
$X^{203}$ is selected from I, L, K, and V;
$X^{204}$ is H;
$X^{205}$ is W;
$X^{206}$ is D;
$X^{207}$ is selected from I and L;
$X^{208}$ is E;
$X^{209}$ is selected from S and T;
$X^{210}$ is L;
$X^{211}$ is L;
$X^{212}$ is selected from G, L, N, and S;
$X^{213}$ is C;
$X^{214}$ is selected from I, L, and V;
$X^{215}$ is R; and
$X^{216}$ is E.

Aspect 310. The IL-7Rα ligand of aspect 270, wherein,
$X^{201}$ is selected from I and V;
$X^{202}$ is P;
$X^{203}$ is W;
$X^{204}$ is C;
$X^{205}$ is T;
$X^{206}$ is L;
$X^{207}$ is D;
$X^{208}$ is P;
$X^{209}$ is G;
$X^{210}$ is selected from L and S;
$X^{211}$ is L;
$X^{212}$ is Q;
$X^{213}$ is C;

X²¹⁴ is A;
X²¹⁵ is selected from W; and
X²¹⁶ is L.

Aspect 311. The IL-7Rα ligand of aspect 270, wherein the IL-7Rα ligand comprises an amino acid sequence selected from any one of SEQ ID NOS: 393-410 and 520-655.

Aspect 312. The IL-7Rα ligand of aspect 270, wherein the IL-7Rα ligand comprises an amino acid sequence similarity greater than 60%, greater than 70%, greater than 75%, greater than 80%, greater than 85%, greater than 90%, or greater than 95% to the amino acid sequence of any one of SEQ ID NOS: 389-410 and 520-655.

Aspect 313. The IL-7Rα ligand of any one of aspects 1 to 312, wherein the IL-7Rα ligand further comprises one or more glycines (-G-) on the N-terminus, on the C-terminus, or on both the N- and C-termini of the IL-7Rα ligand.

Aspect 314. The IL-7Rα ligand of any one of aspects 1 to 313, wherein one or more amino acids independently has one of the following conservative substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); and amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

Aspect 315. The IL-7Rα ligand of any one of aspects 1 to 314 and 336-348, wherein the IL-7Rα ligand comprises a disulfide bond between two cysteines.

Aspect 316. An IL-7Rα binding compound comprising one or more IL-7Rα ligands of any one of aspects 1 to 314 and 336-348.

Aspect 317. The IL-7Rα binding compound of aspect 316, wherein the IL-7Rα binding compound comprises an IL-7Rα homomer, an IL-7Rα-containing heteromer, or an IL-7Rα ligand construct.

Aspect 318. The IL-7Rα binding compound of any one of aspects 316 to 317, wherein the IL-7Rα binding compound comprises an Rγc ligand.

Aspect 319. The IL-7Rα binding compound of aspect 316, wherein the IL-7Rα binding compound comprises an IL-7Rα/Rγc heteromer of any one of SEQ ID NOS: 420-428.

Aspect 320. The IL-7Rα binding compound of aspect 316, wherein the IL-7Rα binding compound comprises an IL-7Rα/Rγc fusion protein of any one of SEQ ID NOS: 411-419.

Aspect 321. The IL-7Rα ligand binding compound of aspect 316, wherein the construct comprises an Fc fragment, an immunoglobulin fragment, or an immunoglobulin.

Aspect 322. The IL-7Rα ligand binding compound of aspect 316, wherein the construct comprises a polypeptide or a polymer.

Aspect 323. A method of treating cancer in a patient comprising administering to a patient in need of such treatment a therapeutically effective amount of the IL-7Rα ligand of any one of aspects 1 to 314 and 336-348, the IL-7Rα binding compound of any one of aspects 316 to 322, or a combination of any of the foregoing.

Aspect 324. A method of treating an autoimmune disease in a patient comprising administering to a patient in need of such treatment a therapeutically effective amount of the IL-7Rα ligand of any one of aspects 1 to 314 and 336-348, the IL-7Rα binding compound of any one of aspects 316 to 322, or a combination of any of the foregoing.

Aspect 325. A method of treating an inflammatory disease in a patient comprising administering to a patient in need of such treatment a therapeutically effective amount of the IL-7Rα ligand of any one of aspects 1 to 314 and 336-348, the IL-7Rα binding compound of any one of aspects 316 to 322, or a combination of any of the foregoing.

Aspect 326. A method of expanding immune cells comprising contacting a population of immune cells ex vivo or in vivo with an effective amount of the IL-7Rα ligand of any one of aspects 1 to 314 and 336-348, the IL-7Rα binding compound of any one of aspects 316 to 322, or a combination of any of the foregoing.

Aspect 327. A method of expanding immune cells comprising contacting a population of immune cells ex vivo or in vivo with an effective amount of the IL-7Rα ligand of any one of aspects 1 to 314 and 336-348, the IL-7Rα binding compound of any one of aspects 316 to 322, or a combination of any of the foregoing.

Aspect 328. A method of boosting a vaccine comprising administering to a patient a vaccine and a therapeutically effective amount of the IL-7Rα ligand of any one of aspects 1 to 314 and 336-348, the IL-7Rα binding compound of any one of aspects 316 to 322, or a combination of any of the foregoing.

Aspect 329. A method of modifying the immune response comprising administering to a patient an effective amount of the IL-7Rα ligand of any one of aspects 1 to 314 and 336-348, the IL-7Rα binding compound of any one of aspects 316 to 322, or a combination of any of the foregoing.

Aspect 330. A pharmaceutical composition comprising the IL-7Rα ligand of any one of aspects 1 to 314 and 336-348, the IL-7Rα binding compound of any one of aspects 316 to 322, or a combination of any of the foregoing.

Aspect 331. The pharmaceutical composition of aspect 330, further comprising a chemotherapeutic agent, an immunomodulator, a checkpoint inhibitor, a vaccine, or a combination of any of the foregoing.

Aspect 332. A nucleic acid encoding for the IL-7Rα ligand of any one of aspects 1 to 314 and 336-348, or the IL-7Rα binding compound of any one of aspects 316 to 322.

Aspect 333. A unique binding site on the IL-7Rα subunit, wherein the unique binding site is characterized by the following properties:

(a) a group of IL-7Rα ligands bind to the unique binding site on the IL-7Rα subunit with an $IC_{50}$ of less than 10 μM, wherein the group of IL-7Rα ligands comprises the IL-7Rα ligands having SEQ ID NOS: 5, 43, 104, 146, and 458;

(b) each of the IL-7Rα ligands within the group competitively bind to the unique binding site on the IL-7Rα subunit with each of other IL-7Rα ligands within the group;

(c) a peptide having the amino acid sequence of SEQ ID. No: 429 does not compete for binding to the unique binding site on the IL-7Rα subunit with the peptides within the group of IL-7Rα ligands; and (d) IL-7Rα ligands having SEQ ID NOS: 5, 43, 104, 146, and 458 do not bind competitively with IL-7 binding to IL-7Rα.

Aspect 334. A compound, wherein the compound binds to the unique binding site of aspect 333 with an $IC_{50}$ of less than 100 μM.

Aspect 335. A method of treating a disease such as cancer, an autoimmune disease, or an inflammatory disease in a patient comprising administering to a patient in need thereof a therapeutically effective amount of the compound of aspect 334.

Aspect 336. An IL-7Rα ligand, wherein the IL-7Rα ligand comprises an amino acid sequence of Formula (10) (SEQ ID NO: 597), an amino acid sequence of Formula (10a) (SEQ ID NO: 598), an amino acid sequence of Formula (10b) (SEQ ID NO: 599), an amino acid sequence of Formula (10c) (SEQ ID NO: 600), an amino acid sequence of Formula (10d) (SEQ ID NO: 601), an amino acid sequence of Formula (10e) (SEQ ID NO: 602), an amino acid sequence of Formula (10f) (SEQ ID NO: 603), or an amino acid sequence of Formula (10g) (SEQ ID NO: 604), a truncated amino acid sequence of any one of Formula (10)-(10g), or an amino acid sequence having greater than 60% sequence similarity to any one of Formula (10)-(10g):

$$-X^{198}-X^{199}-X^{200}-I-P-W-C-T-L-D-P-G-X^{210}-L-Q-C-A-W-L-X^{217}-X^{218}-X^{219}- \quad (10)$$

$$-X^{199}-X^{200}-I-P-W-C-T-L-D-P-G-X^{210}-L-Q-C-A-W-L-X^{217}-X^{218}-X^{219}- \quad (10a)$$

$$-X^{200}-I-P-W-C-T-L-D-P-G-X^{210}-L-Q-C-A-W-L-X^{217}-X^{218}-X^{219}- \quad (10b)$$

$$-I-P-W-C-T-L-D-P-G-X^{210}-L-Q-C-A-W-L-X^{217}-X^{218}-X^{219}- \quad (10c)$$

$$-X^{198}-X^{199}-X^{200}-I-P-W-C-T-L-D-P-G-X^{210}-L-Q-C-A-W-L-X^{217}-X^{218}- \quad (10d)$$

$$-X^{198}-X^{199}-X^{200}-I-P-W-C-T-L-D-P-G-X^{210}-L-Q-C-A-W-L-X^{217}- \quad (10e)$$

$$-X^{198}-X^{199}-X^{200}-I-P-W-C-T-L-D-P-G-X^{210}-L-Q-C-A-W-L- \quad (10f)$$

$$-X^{198}-X^{199}-X^{200}-I-P-W-C-T-L-D-P-X^{210}-L-Q-C-A-W-L- \quad (10g)$$

wherein,
$X^{198}$ is selected from A, G, P, S, T, and V;
$X^{199}$ is selected from F, H, W, and Y;
$X^{200}$ is selected from A, G, H, K, P, R, S, and T;
$X^{210}$ is selected form A, G, P, S, and T;
$X^{217}$ is selected from A, G, H, K, P, R, S, and T;
$X^{218}$ is selected from an amino acid and a single bond; and
$X^{219}$ is selected from an amino acid and a single bond.

Aspect 337. The IL-7Rα ligand of aspect 336, wherein,
$X^{198}$ is selected from V and G;
$X^{199}$ is selected from H and W;
$X^{200}$ is selected from R and G;
$X^{210}$ is selected form G and S;
$X^{217}$ is selected from R and G;
$X^{218}$ is selected from Q, G, K and a single bond; and
$X^{219}$ is selected from G, H, M, and a single bond.

Aspect 338. The IL-7Rα ligand of any one of aspects 336 to 337, wherein $X^{198}$ can be V, $X^{199}$ can be H, and $X^{200}$ can be R.

Aspect 339. The IL-7Rα ligand of any one of aspects 336 to 337, wherein $X^{198}$ can be G, $X^{199}$ can be W, and $X^{200}$ can be G.

Aspect 340. The IL-7Rα ligand of any one of aspects 336 to 337, wherein $X^{210}$ can be G.

Aspect 341. The IL-7Rα ligand of any one of aspects 336 to 337, wherein $X^{210}$ can be S.

Aspect 342. The IL-7Rα ligand of any one of aspects 336 to 337, wherein $X^{217}$ can be R.

Aspect 343. The IL-7Rα ligand of any one of aspects 336 to 337, wherein $X^{217}$ can be R, $X^{218}$ can be Q, and $X^{219}$ can be M.

Aspect 344. The IL-7Rα ligand of any one of aspects 336 to 337, wherein $X^{217}$ can be G, $X^{218}$ can be K, and $X^{219}$ can be H.

Aspect 345. An IL-7Rα ligand comprising an amino acid sequence or a truncated amino acid sequence selected from any one of SEQ ID NOS: 535-537 and 605-655:

```
                                        SEQ ID NO: 537
I P W C T L D P G G L Q C A W L

SEQ ID NO: 536
I P W C T L D P G G L Q C A W L R

SEQ ID NO: 535
I P W C T L D P G G L Q C A W L R Q

SEQ ID NO: 605
I P W C T L D P G G L Q C A W L R G

SEQ ID NO: 606
I P W C T L D P G G L Q C A W L R Q G
```

-continued
```
                                        SEQ ID NO: 607
I P W C T L D P G G L Q C A W L R G G

SEQ ID NO: 608
I P W C T L D P G G L Q C A W L G

SEQ ID NO: 609
I P W C T L D P G G L Q C A W L G K

SEQ ID NO: 610
I P W C T L D P G G L Q C A W L G K H

SEQ ID NO: 611
V H R I P W C T L D P G G L Q C A W L

SEQ ID NO: 612
V H R I P W C T L D P G G L Q C A W L R

SEQ ID NO: 613
V H R I P W C T L D P G G L Q C A W L R Q

SEQ ID NO: 614
V H R I P W C T L D P G G L Q C A W L R G

SEQ ID NO: 615
V H R I P W C T L D P G G L Q C A W L R Q G

SEQ ID NO: 616
V H R I P W C T L D P G G L Q C A W L R G G

SEQ ID NO: 617
V H R I P W C T L D P G G L Q C A W L G

SEQ ID NO: 618
V H R I P W C T L D P G G L Q C A W L G K
```

```
                                   SEQ ID NO: 619
V H R I P W C T L D P G G L Q C A W L G K H

SEQ ID NO: 620
G W G I P W C T L D P G G L Q C A W L

SEQ ID NO: 621
G W G I P W C T L D P G G L Q C A W L R

SEQ ID NO: 622
G W G I P W C T L D P G G L Q C A W L R Q

SEQ ID NO: 623
G W G I P W C T L D P G G L Q C A W L R G

SEQ ID NO: 624
G W G I P W C T L D P G G L Q C A W L R Q G

SEQ ID NO: 625
G W G I P W C T L D P G G L Q C A W L R G G

SEQ ID NO: 626
G W G I P W C T L D P G G L Q C A W L G

SEQ ID NO: 627
G W G I P W C T L D P G G L Q C A W L G K

SEQ ID NO: 628
G W G I P W C T L D P G G L Q C A W L G K H

SEQ ID NO: 629
I P W C T L D P G S L Q C A W L

SEQ ID NO: 630
I P W C T L D P G S L Q C A W L R

SEQ ID NO: 631
I P W C T L D P G S L Q C A W L R Q

SEQ ID NO: 632
I P W C T L D P G S L Q C A W L R G

SEQ ID NO: 633
I P W C T L D P G S L Q C A W L R Q G

SEQ ID NO: 634
I P W C T L D P G S L Q C A W L R G G

SEQ ID NO: 635
I P W C T L D P G S L Q C A W L G

SEQ ID NO: 636
I P W C T L D P G S L Q C A W L G K

SEQ ID NO: 637
I P W C T L D P G S L Q C A W L G K H

SEQ ID NO: 638
V H R I P W C T L D P G S L Q C A W L

SEQ ID NO: 639
V H R I P W C T L D P G S L Q C A W L R

SEQ ID NO: 640
V H R I P W C T L D P G S L Q C A W L R Q

SEQ ID NO: 641
V H R I P W C T L D P G S L Q C A W L R G

SEQ ID NO: 642
V H R I P W C T L D P G S L Q C A W L R Q G

SEQ ID NO: 643
V H R I P W C T L D P G S L Q C A W L R G G

SEQ ID NO: 644
V H R I P W C T L D P G S L Q C A W L G

SEQ ID NO: 645
V H R I P W C T L D P G S L Q C A W L G K

SEQ ID NO: 646
V H R I P W C T L D P G S L Q C A W L G K H

SEQ ID NO: 647
G W G I P W C T L D P G S L Q C A W L

SEQ ID NO: 648
G W G I P W C T L D P G S L Q C A W L R

SEQ ID NO: 649
G W G I P W C T L D P G S L Q C A W L R Q

SEQ ID NO: 650
G W G I P W C T L D P G S L Q C A W L R G

SEQ ID NO: 651
G W G I P W C T L D P G S L Q C A W L R Q G

SEQ ID NO: 652
G W G I P W C T L D P G S L Q C A W L R G G

SEQ ID NO: 653
G W G I P W C T L D P G S L Q C A W L G

SEQ ID NO: 654
G W G I P W C T L D P G S L Q C A W L G K

SEQ ID NO: 655
G W G I P W C T L D P G S L Q C A W L G K H
```

Aspect 346. An IL-7Rα ligand such as an IL-7Rα ligand of any one of Formula (10)-(10g) comprising an amino acid sequence or a truncated amino acid sequence selected from any one of SEQ ID NOS: 407, 514, 554-558, and 589-596:

Aspect 347. An IL-7Rα ligand of any one of aspects 336 to 346, wherein the IL-7Rα ligand comprises a truncated amino acid sequence.

Aspect 348. An IL-7Rα ligand of any one of aspects 336 to 347, wherein the IL-7Rα ligand comprises from 1 to 4 glycines (G) on the N-terminus, on the C-terminus, or on both the N- and C-termini.

Aspect 347. An IL-7Rα ligand of any one of aspects 336 to 348, wherein the IL-7Rα ligand comprises one or more amino acid substitutions such as from 1 to 5 amino acid substitutions.

Aspect 349. An IL-7Rα ligand of any one of aspects 1 to 314, wherein the IL-7Rα ligand comprises a truncated IL-7Rα ligand.

Finally, it should be noted that there are alternative ways of implementing the embodiments disclosed herein. Accordingly, the present embodiments are to be considered as illustrative and not restrictive, and the claims are not to be limited to the details given herein but may be modified within the scope and equivalents thereof.

SEQUENCE LISTING (9429 sequences)

SEQ ID NO: 1 - protein, 14 aa, Artificial Sequence
  Description of Artificial Sequence: Synthetic peptide
  MOD_RES (1)..(1): Any amino acid comprising a small hydrophobic side chain
  MOD_RES (3)..(3): Any amino acid comprising a polar/neutral side chain or an amino acid comprising a large hydrophobic side chain
  MOD_RES (4)..(4): Any amino acid comprising a large hydrophobic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a large hydrophobic side chain
  MOD_RES (8)..(8): Any amino acid comprising an acidic side chain
  MOD_RES (9)..(9): Any amino acid comprising a small hydrophobic side chain
  MOD_RES (10)..(10): Any amino acid comprising a large hydrophobic side chain
  MOD_RES (11)..(11): Any amino acid comprising a large hydrophobic side chain
  MOD_RES (12)..(12): Any amino acid comprising a small hydrophobic side chain or an amino acid comprising a large hydrophobic side chain
  MOD_RES (14)..(14): Any amino acid
XCXXXXXXXXXXCX

SEQ ID NO: 2 - protein, 12 aa, Artificial Sequence
  Description of Artificial Sequence: Synthetic peptide
  MOD_RES (2)..(2): Any amino acid comprising a polar/neutral side chain or an amino acid comprising a large hydrophobic side chain
  MOD_RES (3)..(3): Any amino acid comprising a large hydrophobic side chain
  MOD_RES (4)..(4): Any amino acid comprising a large hydrophobic side chain
  MOD_RES (5)..(5): Any amino acid comprising an acidic side chain
  MOD_RES (6)..(6): Any amino acid comprising a large hydrophobic side chain
  MOD_RES (7)..(7): Any amino acid comprising an acidic side chain
  MOD_RES (8)..(8): Any amino acid comprising a small hydrophobic side chain
  MOD_RES (9)..(9): Any amino acid comprising a large hydrophobic side chain
  MOD_RES (10)..(10): Any amino acid comprising a large hydrophobic side chain
  MOD_RES (11)..(11): Any amino acid comprising a small hydrophobic side chain or an amino acid comprising a large hydrophobic side chain
CXXXXXXXXXXC

SEQ ID NO: 3 - protein, 10 aa, Artificial Sequence
  Description of Artificial Sequence: Synthetic peptide
  MOD_RES (1)..(1): Any amino acid comprising a polar/neutral side chain or an amino acid comprising a large hydrophobic side chain
  MOD_RES (2)..(2): Any amino acid comprising a large hydrophobic side chain
  MOD_RES (3)..(3): Any amino acid comprising a large hydrophobic side chain
  MOD_RES (4)..(4): Any amino acid comprising an acidic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a small hydrophobic side chain
  MOD_RES (8)..(8): Any amino acid comprising a large hydrophobic side chain
  MOD_RES (9)..(9): Any amino acid comprising a large hydrophobic side chain
  MOD_RES (10)..(10): Any amino acid comprising a small hydrophobic side chain or an amino acid comprising a large hydrophobic side chain
XXXXXXXXXX

SEQ ID NO: 4 - protein, 14 aa, Artificial Sequence
  Description of Artificial Sequence: Synthetic peptide
PCFVYPEEDLLVCR

SEQ ID NO: 5 - protein, 14 aa, Artificial Sequence
  Description of Artificial Sequence: Synthetic peptide
QCIHWDIETLLSCV

SEQ ID NO: 6 - protein, 14 aa, Artificial Sequence
  Description of Artificial Sequence: Synthetic peptide
SCSHWDVESLAVCT

SEQ ID NO: 7 - protein, 14 aa, Artificial Sequence
  Description of Artificial Sequence: Synthetic peptide
TCQHQDLQGLLACI

SEQ ID NO: 8 - protein, 14 aa, Artificial Sequence
  Description of Artificial Sequence: Synthetic peptide
YCPHHDLDTLMSCA

SEQ ID NO: 9 - protein, 16 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising an acidic side chain, an amino acid comprising a small hydrophobic side chain, or an amino acid comprising a large hydrophobic side chain
  MOD_RES (3)..(3): Any amino acid comprising a large hydrophobic side chain
  MOD_RES (5)..(5): Any amino acid
  MOD_RES (6)..(6): Any amino acid comprising an acidic side chain or an amino acid comprising a large hydrophobic side chain
  MOD_RES (7)..(7): Any amino acid comprising an acidic side chain or an amino acid comprising a large hydrophobic side chain
  MOD_RES (10)..(10): Any amino acid comprising a small hydrophobic side chain or an amino acid comprising a large hydrophobic side chain
  MOD_RES (11)..(11): Any amino acid comprising a small hydrophobic side chain or an amino acid comprising a large hydrophobic side chain
  MOD_RES (12)..(12): Any amino acid comprising an acidic side chain, an amino acid comprising a polar/neutral side chain, or an amino acid comprising a large hydrophobic side chain
  MOD_RES (14)..(14): Any amino acid
  MOD_RES (15)..(15): Any amino acid comprising a polar/neutral side chain or an amino acid comprising an aromatic side chain
  MOD_RES (16)..(16): Any amino acid comprising a polar/neutral side chain or an amino acid comprising a large hydrophobic side chain
XXXCXXXPGXXXCXXX

SEQ ID NO: 10 - protein, 14 aa, Artificial Sequence
  Description of Artificial Sequence: Synthetic peptide
  MOD_RES (1)..(1): Any amino acid comprising an acidic side chain, an amino acid comprising a small hydrophobic side chain, or an amino acid comprising a large hydrophobic side chain
  MOD_RES (2)..(2): Any amino acid comprising a large hydrophobic side chain
  MOD_RES (4)..(4): Any amino acid
  MOD_RES (5)..(5): Any amino acid comprising an acidic side chain or an amino acid comprising a large hydrophobic side chain
  MOD_RES (6)..(6): Any amino acid comprising an acidic side chain or an amino acid comprising a large hydrophobic side chain
  MOD_RES (9)..(9): Any amino acid comprising a small hydrophobic side chain or an amino acid comprising a large hydrophobic side chain
  MOD_RES (10)..(10): Any amino acid comprising a small hydrophobic side chain or an amino acid comprising a large hydrophobic side chain
  MOD_RES (11)..(11): Any amino acid comprising an acidic side chain, an amino acid comprising a polar/neutral side chain, or an amino acid comprising a large hydrophobic side chain
  MOD_RES (13)..(13): Any amino acid
  MOD_RES (14)..(14): Any amino acid comprising a polar/neutral side chain or an amino acid comprising an aromatic side chain
XXCXXXPGXXXCXX

SEQ ID NO: 11 - protein, 12 aa, Artificial Sequence
  Description of Artificial Sequence: Synthetic peptide
  MOD_RES (1)..(1): Any amino acid comprising a large hydrophobic side chain
  MOD_RES (3)..(3): Any amino acid
  MOD_RES (4)..(4): Any amino acid comprising an acidic side chain or an amino acid comprising a large hydrophobic side chain
  MOD_RES (5)..(5): Any amino acid comprising an acidic side chain or an amino acid comprising a large hydrophobic side chain
  MOD_RES (8)..(8): Any amino acid comprising a small hydrophobic side chain or an amino acid comprising a large hydrophobic side chain
  MOD_RES (9)..(9): Any amino acid comprising a small hydrophobic side chain or an amino acid comprising a large hydrophobic side chain
  MOD_RES (10)..(10): Any amino acid comprising an acidic side chain, an amino acid comprising a polar/neutral side chain, or an amino acid comprising a large hydrophobic side chain
  MOD_RES (12)..(12): Any amino acid
XCXXXPGXXXCX

SEQ ID NO: 12 - protein, 10 aa, Artificial Sequence
  Description of Artificial Sequence: Synthetic peptide
  MOD_RES (2)..(2): Any amino acid
  MOD_RES (3)..(3): Any amino acid comprising an acidic side chain or an amino acid comprising a large hydrophobic side chain
  MOD_RES (4)..(4): Any amino acid comprising an acidic side chain or an amino acid comprising a large hydrophobic side chain
  MOD_RES (7)..(7): Any amino acid comprising a small hydrophobic side chain or an amino acid comprising a large hydrophobic side chain
  MOD_RES (8)..(8): Any amino acid comprising a small hydrophobic side chain or an amino acid comprising a large hydrophobic side chain
  MOD_RES (9)..(9): Any amino acid comprising an acidic side chain, an amino acid comprising a polar/neutral side chain, or an amino acid comprising a large hydrophobic side chain
CXXXPGXXXC

SEQ ID NO: 13 - protein, 8 aa, Artificial Sequence
  Description of Artificial Sequence: Synthetic peptide
  MOD_RES (1)..(1): Any amino acid
  MOD_RES (2)..(2): Any amino acid comprising an acidic side chain or an amino acid comprising a large hydrophobic side chain
  MOD_RES (3)..(3): Any amino acid comprising an acidic side chain or an amino acid comprising a large hydrophobic side chain
  MOD_RES (6)..(6): Any amino acid comprising a small hydrophobic side chain or an amino acid comprising a large hydrophobic side chain
  MOD_RES (7)..(7): Any amino acid comprising a small hydrophobic side chain or an amino acid comprising a large hydrophobic side chain
  MOD_RES (8)..(8): Any amino acid comprising an acidic side chain, an amino acid comprising a polar/neutral side chain, or an amino acid comprising a large hydrophobic side chain
XXXPGXXX

SEQ ID NO: 14 - protein, 16 aa, Artificial Sequence
  Description of Artificial Sequence: Synthetic peptide
DWLCRTDPGYLDCVSF

SEQ ID NO: 15 - protein, 16 aa, Artificial Sequence
  Description of Artificial Sequence: Synthetic peptide
DWLCRPGPGLLVCQWF

SEQ ID NO: 16 - protein, 16 aa, Artificial Sequence
  Description of Artificial Sequence: Synthetic peptide
IPWCTLWPGGPECQTL

SEQ ID NO: 17 - protein, 16 aa, Artificial Sequence
  Description of Artificial Sequence: Synthetic peptide
RYECADLPGGLHCEFR

SEQ ID NO: 18 - protein, 16 aa, Artificial Sequence
  Description of Artificial Sequence: Synthetic peptide
SYACDMNPGWDFCSDT

SEQ ID NO: 19 - protein, 16 aa, Artificial Sequence
  Description of Artificial Sequence: Synthetic peptide
VPWCSLDPGSVQCVHS

SEQ ID NO: 20 - protein, 16 aa, Artificial Sequence
  Description of Artificial Sequence: Synthetic peptide
VDWCDLAPGDFRCAWM

SEQ ID NO: 21 - protein, 16 aa, Artificial Sequence
  Description of Artificial Sequence: Synthetic peptide
VPWCTLDPGSTQCAVI

SEQ ID NO: 22 - protein, 15 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a large hydrophobic side chain
  MOD_RES (3)..(3): Any amino acid comprising a small hydrophobic side chain or an amino acid comprising a large hydrophobic side chain
  MOD_RES (5)..(5): Any amino acid comprising an acidic side chain, an amino acid comprising a hydroxyl side chain, or an amino acid comprising a large hydrophobic side chain
  MOD_RES (6)..(6): Any amino acid comprising a large hydrophobic side chain
  MOD_RES (7)..(7): Any amino acid comprising a small hydrophobic side chain, an amino acid comprising an acidic side chain, an amino acid comprising a polar/neutral side chain, or an amino acid comprising a basic side chain
  MOD_RES (8)..(8): Any amino acid comprising a small hydrophobic side chain or an amino acid comprising a polar/neutral side chain
  MOD_RES (9)..(9): Any amino acid comprising polar/neutral side chain or an amino acid comprising a large hydrophobic side chain
  MOD_RES (10)..(10): Any amino acid comprising a basic side chain
  MOD_RES (11)..(11): Any amino acid comprising a large hydrophobic side chain
  MOD_RES (12)..(12): Any amino acid comprising a basic side chain
  MOD_RES (14)..(14): Any amino acid comprising a small hydrophobic side chain
  MOD_RES (15)..(15): Any amino acid comprising a polar/neutral side chain or an amino acid comprising a large hydrophobic side chain
XXXCXXXXXXXXCXX

SEQ ID NO: 23 - protein, 14 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a small hydrophobic side chain or an amino acid comprising a large hydrophobic side chain
  MOD_RES (4)..(4): Any amino acid comprising an acidic side chain, an amino acid comprising a hydroxyl side chain, or an amino acid comprising a large hydrophobic side chain
  MOD_RES (5)..(5): Any amino acid comprising a large hydrophobic side chain
  MOD_RES (6)..(6): Any amino acid comprising a small hydrophobic side chain, an amino acid comprising an acidic side chain, an amino acid comprising a polar/neutral side chain, or an amino acid comprising a basic side chain
  MOD_RES (7)..(7): Any amino acid comprising a small hydrophobic side chain or an amino acid comprising a polar/neutral side chain
  MOD_RES (8)..(8): Any amino acid comprising polar/neutral side chain or an amino acid comprising a large hydrophobic side chain
  MOD_RES (9)..(9): Any amino acid comprising a basic side chain
  MOD_RES (10)..(10): Any amino acid comprising a large hydrophobic side chain
  MOD_RES (11)..(11): Any amino acid comprising a basic side chain
  MOD_RES (13)..(13): Any amino acid comprising a small hydrophobic side chain
  MOD_RES (14)..(14): Any amino acid comprising a polar/neutral side chain or an amino acid comprising a large hydrophobic side chain
XXCXXXXXXXXCXX

SEQ ID NO: 24 - protein, 12 aa, Artificial Sequence
  Description of Artificial Sequence: Synthetic peptide
  MOD_RES (1)..(1): Any amino acid comprising a small hydrophobic side chain or an amino acid comprising a large hydrophobic side chain
  MOD_RES (3)..(3): Any amino acid comprising an acidic side chain, an amino acid comprising a hydroxyl side chain, or an amino acid comprising a large hydrophobic side chain
  MOD_RES (4)..(4): Any amino acid comprising a large hydrophobic side chain
  MOD_RES (5)..(5): Any amino acid comprising a small hydrophobic side chain, an amino acid comprising an acidic side chain, an amino acid comprising a polar/neutral side chain, or an amino acid comprising a basic side chain
  MOD_RES (6)..(6): Any amino acid comprising a small hydrophobic side chain or an amino acid comprising a polar/neutral side chain
  MOD_RES (7)..(7): Any amino acid comprising polar/neutral side chain or an amino acid comprising a large hydrophobic side chain
  MOD_RES (8)..(8): Any amino acid comprising a basic side chain
  MOD_RES (9)..(9): Any amino acid comprising a large hydrophobic side chain
  MOD_RES (10)..(10): Any amino acid comprising a basic side chain
  MOD_RES (12)..(12): Any amino acid comprising a small hydrophobic side chain
XCXXXXXXXXCX

SEQ ID NO: 25 - protein, 10 aa, Artificial Sequence
  Description of Artificial Sequence: Synthetic peptide
  MOD_RES (2)..(2): Any amino acid comprising an acidic side chain, an amino acid comprising a hydroxyl side chain, or an amino acid comprising a large hydrophobic side chain
  MOD_RES (3)..(3): Any amino acid comprising a large hydrophobic side chain
  MOD_RES (4)..(4): Any amino acid comprising a small hydrophobic side chain, an amino acid comprising an acidic side chain, an amino acid comprising a polar/neutral side chain, or an amino acid comprising a basic side chain
  MOD_RES (5)..(5): Any amino acid comprising a small hydrophobic side chain or an amino acid comprising a polar/neutral side chain
  MOD_RES (6)..(6): Any amino acid comprising polar/neutral side chain or an amino acid comprising a large hydrophobic side chain
  MOD_RES (7)..(7): Any amino acid comprising a basic side chain
  MOD_RES (8)..(8): Any amino acid comprising a large hydrophobic side chain
  MOD_RES (9)..(9): Any amino acid comprising a basic side chain
CXXXXXXXXC

SEQ ID NO: 26 - protein, 8 aa, Artificial Sequence
  Description of Artificial Sequence: Synthetic peptide
  MOD_RES (1)..(1): Any amino acid comprising an acidic side chain, an amino acid comprising a hydroxyl side chain, or an amino acid comprising a large hydrophobic side chain
  MOD_RES (2)..(2): Any amino acid comprising a large hydrophobic side chain
  MOD_RES (3)..(3): Any amino acid comprising a small hydrophobic side chain, an amino acid comprising an acidic side chain, an amino acid comprising a polar/neutral side chain, or an amino acid comprising a basic side chain
  MOD_RES (4)..(4): Any amino acid comprising a small hydrophobic side chain or an amino acid comprising a polar/neutral side chain
  MOD_RES (5)..(5): Any amino acid comprising polar/neutral side chain or an amino acid comprising a large hydrophobic side chain
  MOD_RES (6)..(6): Any amino acid comprising a basic side chain
  MOD_RES (7)..(7): Any amino acid comprising a large hydrophobic side chain
  MOD_RES (8)..(8): Any amino acid comprising a basic side chain
XXXXXXXX

SEQ ID NO: 27 - protein, 14 aa, Artificial Sequence
  Description of Artificial Sequence: Synthetic peptide
FWCEVFAGIKVCRP

SEQ ID NO: 28 - protein, 14 aa, Artificial Sequence
  Description of Artificial Sequence: Synthetic peptide
IFCAIFHGVKVCRS

SEQ ID NO: 29 - protein, 14 aa, Artificial Sequence
  Description of Artificial Sequence: Synthetic peptide
IYCQIFDTVKICRS

SEQ ID NO: 30 - protein, 14 aa, Artificial Sequence
  Description of Artificial Sequence: Synthetic peptide
IYCMEFLSGRVCRG

SEQ ID NO: 31 - protein, 14 aa, Artificial Sequence
  Description of Artificial Sequence: Synthetic peptide
IACANFHGTRVCRT

SEQ ID NO: 32 - protein, 14 aa, Artificial Sequence
  Description of Artificial Sequence: Synthetic peptide
IYCAFLSGYKTCRS

SEQ ID NO: 33 - protein, 14 aa, Artificial Sequence
  Description of Artificial Sequence: Synthetic peptide
IDCFDFGFTKVCRP

SEQ ID NO: 34 - protein, 14 aa, Artificial Sequence
  Description of Artificial Sequence: Synthetic peptide
IYCAYLHGYKVCRK

SEQ ID NO: 35 - protein, 14 aa, Artificial Sequence
  Description of Artificial Sequence: Synthetic peptide
IYCISISNHKVCRA

SEQ ID NO: 36 - protein, 14 aa, Artificial Sequence
  Description of Artificial Sequence: Synthetic peptide
LYCMVFPAGKVCRS

SEQ ID NO: 37 - protein, 14 aa, Artificial Sequence
  Description of Artificial Sequence: Synthetic peptide
LQCVVIRNQKLCRG

SEQ ID NO: 38 - protein, 14 aa, Artificial Sequence
  Description of Artificial Sequence: Synthetic peptide
LECVTIKGYKLCRL

SEQ ID NO: 39 - protein, 14 aa, Artificial Sequence
  Description of Artificial Sequence: Synthetic peptide
LDCIYFGQIKVCRA

SEQ ID NO: 40 - protein, 14 aa, Artificial Sequence
  Description of Artificial Sequence: Synthetic peptide
LYCAELHGFRVCRL

SEQ ID NO: 41 - protein, 14 aa, Artificial Sequence
  Description of Artificial Sequence: Synthetic peptide
LQCTVINSFKLCRL

SEQ ID NO: 42 - protein, 14 aa, Artificial Sequence
  Description of Artificial Sequence: Synthetic peptide
LYCIESYNLRSCRI

SEQ ID NO: 43 - protein, 14 aa, Artificial Sequence
  Description of Artificial Sequence: Synthetic peptide
VYCAEIGEYRVCRQ

SEQ ID NO: 44 - protein, 14 aa, Artificial Sequence
  Description of Artificial Sequence: Synthetic peptide
VQCVFIAPYKLCRS

SEQ ID NO: 45 - protein, 14 aa, Artificial Sequence
  Description of Artificial Sequence: Synthetic peptide
VHCMSFEGQRVCRA

SEQ ID NO: 46 - protein, 14 aa, Artificial Sequence
  Description of Artificial Sequence: Synthetic peptide
VFCIDFPVYRVCRA

SEQ ID NO: 47 - protein, 14 aa, Artificial Sequence
  Description of Artificial Sequence: Synthetic peptide
VFCTTIHGQKLCRA

SEQ ID NO: 48 - protein, 14 aa, Artificial Sequence
  Description of Artificial Sequence: Synthetic peptide
VVCAYFWDQKVCRE

SEQ ID NO: 49 - protein, 14 aa, Artificial Sequence
  Description of Artificial Sequence: Synthetic peptide
VYCAKFDEVKVCRA

SEQ ID NO: 50 - protein, 17 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a small hydrophobic side chain or an amino acid comprising a polar/neutral side chain
  MOD_RES (3)..(3): Any amino acid comprising a large hydrophobic side chain
  MOD_RES (4)..(4): Any amino acid comprising a large hydrophobic side chain
  MOD_RES (6)..(6): Any amino acid comprising a large hydrophobic side chain
  MOD_RES (7)..(7): Any amino acid comprising a basic side chain or an amino acid comprising a polar/neutral side chain
  MOD_RES (8)..(8): Any amino acid comprising a large hydrophobic side chain
  MOD_RES (9)..(9): Any amino acid comprising a small hydrophobic side chain
  MOD_RES (10)..(10): Any amino acid comprising a small hydrophobic side chain
  MOD_RES (11)..(11): Any amino acid
  MOD_RES (12)..(12): Any amino acid comprising a basic side chain or an amino acid comprising a large hydrophobic side chain
  MOD_RES (13)..(13): Any amino acid comprising a large hydrophobic side chain
  MOD_RES (15)..(15): Any amino acid comprising a basic side chain
  MOD_RES (16)..(16): Any amino acid comprising a small hydrophobic side chain
  MOD_RES (17)..(17): Any amino acid comprising a polar/neutral side chain
XXXXCXXXXXXXXCXXX

SEQ ID NO: 51 - protein, 16 aa, Artificial Sequence
  Description of Artificial Sequence: Synthetic peptide
  MOD_RES (1)..(1): Any amino acid comprising a small hydrophobic side chain or an amino acid comprising a polar/neutral side chain
  MOD_RES (2)..(2): Any amino acid comprising a large hydrophobic side chain
  MOD_RES (3)..(3): Any amino acid comprising a large hydrophobic side chain
  MOD_RES (5)..(5): Any amino acid comprising a large hydrophobic side chain
  MOD_RES (6)..(6): Any amino acid comprising a basic side chain or an amino acid comprising a polar/neutral side chain
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising a small hydrophobic side chain
  MOD_RES (10)..(10): Any amino acid
  MOD_RES (11)..(11): Any amino acid comprising a basic side chain or an amino acid comprising a large hydrophobic side chain
  MOD_RES (12)..(12): Any amino acid comprising a large hydrophobic side chain
  MOD_RES (14)..(14): Any amino acid comprising a basic side chain
  MOD_RES (15)..(15): Any amino acid comprising a small hydrophobic side chain
  MOD_RES (16)..(16): Any amino acid comprising a polar/neutral side chain
XXXCXXXXXXXXCXXX

SEQ ID NO: 52 - protein, 14 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a large hydrophobic side chain
  MOD_RES (4)..(4): Any amino acid comprising a large hydrophobic side chain
  MOD_RES (5)..(5): Any amino acid comprising a basic side chain or an amino acid comprising a polar/neutral side chain
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid
  MOD_RES (10)..(10): Any amino acid comprising a basic side chain or an amino acid comprising a large hydrophobic side chain
  MOD_RES (11)..(11): Any amino acid comprising a large hydrophobic side chain
  MOD_RES (13)..(13): Any amino acid comprising a basic side chain
  MOD_RES (14)..(14): Any amino acid comprising a small hydrophobic side chain
XXCXXXXXXXXCXX

SEQ ID NO: 53 - protein, 12 aa, Artificial Sequence
  Description of Artificial Sequence: Synthetic peptide
  MOD_RES (1)..(1): Any amino acid comprising a large hydrophobic side chain
  MOD_RES (3)..(3): Any amino acid comprising a large hydrophobic side chain
  MOD_RES (4)..(4): Any amino acid comprising a basic side chain or an amino acid comprising a polar/neutral side chain
  MOD_RES (5)..(5): Any amino acid comprising a large hydrophobic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid
  MOD_RES (9)..(9): Any amino acid comprising a basic side chain or an amino acid comprising a large hydrophobic side chain
  MOD_RES (10)..(10): Any amino acid comprising a large hydrophobic side chain
  MOD_RES (12)..(12): Any amino acid comprising a basic side chain
XCXXXXXXXXCX

SEQ ID NO: 54 - protein, 10 aa, Artificial Sequence
  Description of Artificial Sequence: Synthetic peptide
  MOD_RES (2)..(2): Any amino acid comprising a large hydrophobic side chain
  MOD_RES (3)..(3): Any amino acid comprising a basic side chain or an amino acid comprising a polar/neutral side chain
  MOD_RES (4)..(4): Any amino acid comprising a large hydrophobic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid
  MOD_RES (8)..(8): Any amino acid comprising a basic side chain or an amino acid comprising a large hydrophobic side chain
  MOD_RES (9)..(9): Any amino acid comprising a large hydrophobic side chain
CXXXXXXXXC

SEQ ID NO: 55 - protein, 8 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a basic side chain or an amino acid comprising a polar/neutral side chain
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid comprising a small hydrophobic side chain
  MOD_RES (6)..(6): Any amino acid
  MOD_RES (7)..(7): Any amino acid comprising a basic side chain or an amino acid comprising a large hydrophobic side chain
  MOD_RES (8)..(8): Any amino acid comprising a large hydrophobic side chain
XXXXXXXX

SEQ ID NO: 56 - protein, 16 aa, Artificial Sequence
  Description of Artificial Sequence: Synthetic peptide
GVYCLLGPGTVPCRAL

SEQ ID NO: 57 - protein, 16 aa, Artificial Sequence
  Description of Artificial Sequence: Synthetic peptide
HVYCLHGPGSVPCRSH

SEQ ID NO: 58 - protein, 16 aa, Artificial Sequence
  Description of Artificial Sequence: Synthetic peptide
HVYCLHGPGSVPCRSH

SEQ ID NO: 59 - protein, 16 aa, Artificial Sequence
  Description of Artificial Sequence: Synthetic peptide
LVFCEMFPGGRVCRGE

SEQ ID NO: 60 - protein, 16 aa, Artificial Sequence
  Description of Artificial Sequence: Synthetic peptide
NIACMRFPGGYVCRNY

SEQ ID NO: 61 - protein, 16 aa, Artificial Sequence
  Description of Artificial Sequence: Synthetic peptide
NIACMRFPGGYVCRNY

SEQ ID NO: 62 - protein, 16 aa, Artificial Sequence
  Description of Artificial Sequence: Synthetic peptide
PVYCMELPGHRVCRGS

SEQ ID NO: 63 - protein, 14 aa, Artificial Sequence
  Description of Artificial Sequence: Synthetic peptide
PIYCAKLPGGYNCR

SEQ ID NO: 64 - protein, 16 aa, Artificial Sequence
  Description of Artificial Sequence: Synthetic peptide
PVVCATLPGGYVCRVT

SEQ ID NO: 65 - protein, 16 aa, Artificial Sequence
  Description of Artificial Sequence: Synthetic peptide
PVYCMELPGHRVCRGS

SEQ ID NO: 66 - protein, 16 aa, Artificial Sequence
  Description of Artificial Sequence: Synthetic peptide
QVYCQVFPGFKACRTR

SEQ ID NO: 67 - protein, 16 aa, Artificial Sequence
  Description of Artificial Sequence: Synthetic peptide
RVFCINLPGQRVCRLS

SEQ ID NO: 68 - protein, 16 aa, Artificial Sequence
  Description of Artificial Sequence: Synthetic peptide
RIFCVTLPGGKSCRTF

SEQ ID NO: 69 - protein, 16 aa, Artificial Sequence
  Description of Artificial Sequence: Synthetic peptide
RIYCMVLPGGYNCRAN

SEQ ID NO: 70 - protein, 16 aa, Artificial Sequence
  Description of Artificial Sequence: Synthetic peptide
SVFCVQFPGYKVCRSS

SEQ ID NO: 71 - protein, 16 aa, Artificial Sequence
  Description of Artificial Sequence: Synthetic peptide
TIACVNLPGGYVCREY

SEQ ID NO: 72 - protein, 16 aa, Artificial Sequence
  Description of Artificial Sequence: Synthetic peptide
VVYCIQFPGYKVCRSR

SEQ ID NO: 73 - protein, 16 aa, Artificial Sequence
  Description of Artificial Sequence: Synthetic peptide
VQCVTNLPGIQKVCRS

SEQ ID NO: 74 - protein, 15 aa, Artificial Sequence
  Description of Artificial Sequence: Synthetic peptide
  MOD_RES (1)..(1): C, K, R, S, or V
  MOD_RES (2)..(2): C or S
  MOD_RES (3)..(3): K, L, R, or S
  MOD_RES (4)..(4): G, H, R, S, or T
  MOD_RES (5)..(5): G, R, T, V, or W
  MOD_RES (6)..(6): D, F, P, or R
  MOD_RES (7)..(7): L, M, or W
  MOD_RES (8)..(8): D, E, or V
  MOD_RES (9)..(9): L, N, P, or S
  MOD_RES (10)..(10): D, F, L, or W
  MOD_RES (11)..(11): L, N, or W
  MOD_RES (12)..(12): G, I, L, or Q
  MOD_RES (13)..(13): C, F, N, or S
  MOD_RES (14)..(14): C, I or R
  MOD_RES (15)..(15): L or N
XXXXXXXXXXXXXXX

SEQ ID NO: 75 - protein, 13 aa, Artificial Sequence
  Description of Artificial Sequence: Synthetic peptide
  MOD_RES (1)..(1): C or S
  MOD_RES (2)..(2): K, L, R, or S
  MOD_RES (3)..(3): G, H, R, S, or T
  MOD_RES (4)..(4): G, R, T, V, or W
  MOD_RES (5)..(5): D, F, P, or R
  MOD_RES (6)..(6): L, M, or W
  MOD_RES (7)..(7): D, E, or V
  MOD_RES (8)..(8): L, N, P, or S
  MOD_RES (9)..(9): D, F, L, or W
  MOD_RES (10)..(10): L, N, or W
  MOD_RES (11)..(11): G, I, L, or Q
  MOD_RES (12)..(12): C, F, N, or S
  MOD_RES (13)..(13): C, I or R
XXXXXXXXXXXXX

SEQ ID NO: 76 - protein, 11 aa, Artificial Sequence
  Description of Artificial Sequence: Synthetic peptide
  MOD_RES (1)..(1): K, L, R, or S
  MOD_RES (2)..(2): G, H, R, S, or T
  MOD_RES (3)..(3): G, R, T, V, or W
  MOD_RES (4)..(4): D, F, P, or R
  MOD_RES (5)..(5): L, M, or W
  MOD_RES (6)..(6): D, E, or V
  MOD_RES (7)..(7): L, N, P, or S
  MOD_RES (8)..(8): D, F, L, or W
  MOD_RES (9)..(9): L, N, or W
  MOD_RES (10)..(10): G, I, L, or Q
  MOD_RES (11)..(11): C, F, N, or S
XXXXXXXXXXX

SEQ ID NO: 77 - protein, 9 aa, Artificial Sequence
  Description of Artificial Sequence: Synthetic peptide
  MOD_RES (1)..(1): G, H, R, S, or T
  MOD_RES (2)..(2): G, R, T, V, or W
  MOD_RES (3)..(3): D, F, P, or R
  MOD_RES (4)..(4): L, M, or W
  MOD_RES (5)..(5): D, E, or V
  MOD_RES (6)..(6): L, N, P, or S
  MOD_RES (7)..(7): D, F, L, or W
  MOD_RES (8)..(8): L, N, or W
  MOD_RES (9)..(9): G, I, L, or Q
XXXXXXXXX

SEQ ID NO: 78 - protein, 14 aa, Artificial Sequence
  Description of Artificial Sequence: Synthetic peptide
CSRRVPWVLDNIFC

SEQ ID NO: 79 - protein, 15 aa, Artificial Sequence
  Description of Artificial Sequence: Synthetic peptide
KCSSRRLDLWWLNCN

SEQ ID NO: 80 - protein, 15 aa, Artificial Sequence
  Description of Artificial Sequence: Synthetic peptide
RCKGGFMVPFLGSCL

SEQ ID NO: 81 - protein, 14 aa, Artificial Sequence
  Description of Artificial Sequence: Synthetic peptide
SCLHWDLESLLQCI

SEQ ID NO: 82 - protein, 14 aa, Artificial Sequence
  Description of Artificial Sequence: Synthetic peptide
VCRTTRLDNWWGCR

SEQ ID NO: 83 - protein, 12 aa, Artificial Sequence
  Description of Artificial Sequence: Synthetic peptide
ANRVHVQQGFWW

SEQ ID NO: 84 - protein, 14 aa, Artificial Sequence
  Description of Artificial Sequence: Synthetic peptide
FVFCGQDYQMCKNF

SEQ ID NO: 85 - protein, 12 aa, Artificial Sequence
  Description of Artificial Sequence: Synthetic peptide
GDSQVAYWSPYA

SEQ ID NO: 86 - protein, 15 aa, Artificial Sequence
  Description of Artificial Sequence: Synthetic peptide
HCRLQKPGFHRSSCY

SEQ ID NO: 87 - protein, 14 aa, Artificial Sequence
  Description of Artificial Sequence: Synthetic peptide
HCRLQKPGFHRSSC

SEQ ID NO: 88 - protein, 15 aa, Artificial Sequence
  Description of Artificial Sequence: Synthetic peptide
ISCYFPAGLKPLCRY

SEQ ID NO: 89 - protein, 13 aa, Artificial Sequence
  Description of Artificial Sequence: Synthetic peptide
KEAGGPPGGEGGR

SEQ ID NO: 90 - protein, 15 aa, Artificial Sequence
  Description of Artificial Sequence: Synthetic peptide
KLCRGGWVWLDWCVN

SEQ ID NO: 91 - protein, 15 aa, Artificial Sequence
  Description of Artificial Sequence: Synthetic peptide
LVCWTHWSNQRLCRT

SEQ ID NO: 92 - protein, 15 aa, Artificial Sequence
  Description of Artificial Sequence: Synthetic peptide
LHCWEHWLGTKICRL

SEQ ID NO: 93 - protein, 16 aa, Artificial Sequence
  Description of Artificial Sequence: Synthetic peptide
LVFCEMFPGGRVCRGE

SEQ ID NO: 94 - protein, 15 aa, Artificial Sequence
  Description of Artificial Sequence: Synthetic peptide
NVFCVYFDSKVCRTR

SEQ ID NO: 95 - protein, 14 aa, Artificial Sequence
  Description of Artificial Sequence: Synthetic peptide
NVFCVYFDSKVCRT

SEQ ID NO: 96 - protein, 15 aa, Artificial Sequence
  Description of Artificial Sequence: Synthetic peptide
QNCYELRDAALMCAM

SEQ ID NO: 97 - protein, 16 aa, Artificial Sequence
  Description of Artificial Sequence: Synthetic peptide
QVCCIHFPGRMVCRAC

SEQ ID NO: 98 - protein, 12 aa, Artificial Sequence
  Description of Artificial Sequence: Synthetic peptide
SRDVRELIVIAS

SEQ ID NO: 99 - protein, 12 aa, Artificial Sequence
  Description of Artificial Sequence: Synthetic peptide
TVLSFEAWQILF

SEQ ID NO: 100 - protein, 15 aa, Artificial Sequence
  Description of Artificial Sequence: Synthetic peptide
VCCVDLNSVKICRRC

SEQ ID NO: 101 - protein, 16 aa, Artificial Sequence
  Description of Artificial Sequence: Synthetic peptide
WRICCINPGLRVCRQC

SEQ ID NO: 102 - protein, 12 aa, Artificial Sequence
  Description of Artificial Sequence: Synthetic peptide
YRQLCLDALLSI

SEQ ID NO: 103 - protein, 14 aa, Artificial Sequence
  Description of Artificial Sequence: Synthetic peptide
YWACSSGMNLCRWN

SEQ ID NO: 104 - protein, 14 aa, Artificial Sequence
  Description of Artificial Sequence: Synthetic peptide
YMACSSGLSLCRLS

SEQ ID NO: 105 - protein, 14 aa, Artificial Sequence
  Description of Artificial Sequence: Synthetic peptide
YLACSTTLGKCRWN

SEQ ID NO: 106 - protein, 28 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid
  MOD_RES (3)..(3): Any amino acid comprising a polar/neutral side chain
  MOD_RES (4)..(4): Any amino acid comprising a polar neutral side chain or an amino acid comprising a basic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a polar/neutral hydrophobic side chain, or amino acid comprising an acidic side chain, or an amino acid comprising an aromatic side chain
  MOD_RES (9)..(9): Any amino acid comprising a large hydrophobic side chain
  MOD_RES (10)..(10): Any amino acid comprising a basic side chain
  MOD_RES (11)..(11): Any amino acid comprising a large hydrophobic side chain
  MOD_RES (12)..(12): Any amino acid comprising an acidic side chain
  MOD_RES (13)..(13): Any amino acid comprising a large hydrophobic side chain
  MOD_RES (14)..(14): Any amino acid comprising an acidic side chain
  MOD_RES (15)..(15): Any amino acid comprising a hydroxyl-containing side chain
  MOD_RES (16)..(16): Any amino acid comprising a large hydrophobic side chain
  MOD_RES (17)..(17): Any amino acid comprising a large hydrophobic side chain
  MOD_RES (18)..(18): Any amino acid comprising a small hydrophobic side chain
  MOD_RES (20)..(20): Any amino acid comprising a large hydrophobic side chain
  MOD_RES (21)..(21): Any amino acid comprising an acidic side chain, an amino acid comprising a polar/neutral side chain, or an amino acid comprising a basic side chain
  MOD_RES (22)..(22): Any amino acid
  MOD_RES (23)..(23): Any amino acid
  MOD_RES (24)..(24): Any amino acid
  MOD_RES (25)..(25): Any amino acid
  MOD_RES (26)..(26): Any amino acid
  MOD_RES (27)..(27): Any amino acid
  MOD_RES (28)..(28): Any amino acid
XXXXXXXCXXXXXXXXXXCXXXXXXXXX

SEQ ID NO: 107 - protein, 18 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid comprising a small hydrophobic side chain
  MOD_RES (3)..(3): Any amino acid comprising a polar/neutral hydrophobic side chain, or amino acid comprising an acidic side chain, or an amino acid comprising an aromatic side chain
  MOD_RES (5)..(5): Any amino acid comprising a large hydrophobic side chain
  MOD_RES (6)..(6): Any amino acid comprising a basic side chain
  MOD_RES (7)..(7): Any amino acid comprising a large hydrophobic side chain
  MOD_RES (8)..(8): Any amino acid comprising an acidic side chain
  MOD_RES (9)..(9): Any amino acid comprising a large hydrophobic side chain
  MOD_RES (10)..(10): Any amino acid comprising an acidic side chain
  MOD_RES (11)..(11): Any amino acid comprising a hydroxyl-containing side chain
  MOD_RES (12)..(12): Any amino acid comprising a large hydrophobic side chain
  MOD_RES (13)..(13): Any amino acid comprising a large hydrophobic side chain
  MOD_RES (14)..(14): Any amino acid comprising a small hydrophobic side chain
  MOD_RES (16)..(16): Any amino acid comprising a large hydrophobic side chain
  MOD_RES (17)..(17): Any amino acid comprising an acidic side chain, an amino acid comprising a polar/neutral side chain, or an amino acid comprising a basic side chain
  MOD_RES (18)..(18): Any amino acid
XXXCXXXXXXXXXXCXXX

SEQ ID NO: 108 - protein, 16 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid comprising a polar/neutral hydrophobic side chain, or amino acid comprising an acidic side chain, or an amino acid comprising an aromatic side chain
  MOD_RES (4)..(4): Any amino acid comprising a large hydrophobic side chain
  MOD_RES (5)..(5): Any amino acid comprising a basic side chain
  MOD_RES (6)..(6): Any amino acid comprising a large hydrophobic side chain
  MOD_RES (7)..(7): Any amino acid comprising an acidic side chain
  MOD_RES (8)..(8): Any amino acid comprising a large hydrophobic side chain
  MOD_RES (9)..(9): Any amino acid comprising an acidic side chain
  MOD_RES (10)..(10): Any amino acid comprising a hydroxyl-containing side chain
  MOD_RES (11)..(11): Any amino acid comprising a large hydrophobic side chain
  MOD_RES (12)..(12): Any amino acid comprising a large hydrophobic side chain
  MOD_RES (13)..(13): Any amino acid comprising a small hydrophobic side chain
  MOD_RES (15)..(15): Any amino acid comprising a large hydrophobic side chain
  MOD_RES (16)..(16): Any amino acid comprising an acidic side chain, an amino acid comprising a polar/neutral side chain, or an amino acid comprising a basic side chain
XXCXXXXXXXXXXCXX

SEQ ID NO: 109 - protein, 14 aa, Artificial Sequence
  Description of Artificial Sequence: Synthetic peptide
  MOD_RES (1)..(1): Any amino acid comprising a polar/neutral hydrophobic side chain, or amino acid comprising an acidic side chain, or an amino acid comprising an aromatic side chain
  MOD_RES (3)..(3): Any amino acid comprising a large hydrophobic side chain
  MOD_RES (4)..(4): Any amino acid comprising a basic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a large hydrophobic side chain
  MOD_RES (8)..(8): Any amino acid comprising an acidic side chain
  MOD_RES (9)..(9): Any amino acid comprising a hydroxyl-containing side chain
  MOD_RES (10)..(10): Any amino acid comprising a large hydrophobic side chain
  MOD_RES (11)..(11): Any amino acid comprising a large hydrophobic side chain
  MOD_RES (12)..(12): Any amino acid comprising a small hydrophobic side chain
  MOD_RES (14)..(14): Any amino acid comprising a large hydrophobic side chain
XCXXXXXXXXXXCX

SEQ ID NO: 110 - protein, 12 aa, Artificial Sequence
  Description of Artificial Sequence: Synthetic peptide
  MOD_RES (2)..(2): Any amino acid comprising a large hydrophobic side chain
  MOD_RES (3)..(3): Any amino acid comprising a basic side chain
  MOD_RES (4)..(4): Any amino acid comprising a large hydrophobic side chain
  MOD_RES (5)..(5): Any amino acid comprising an acidic side chain
  MOD_RES (6)..(6): Any amino acid comprising a large hydrophobic side chain
  MOD_RES (7)..(7): Any amino acid comprising an acidic side chain
  MOD_RES (8)..(8): Any amino acid comprising a hydroxyl-containing side chain
  MOD_RES (9)..(9): Any amino acid comprising a large hydrophobic side chain
  MOD_RES (10)..(10): Any amino acid comprising a large hydrophobic side chain
  MOD_RES (11)..(11): Any amino acid comprising a small hydrophobic side chain
CXXXXXXXXXXC

SEQ ID NO: 111 - protein, 10 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a basic side chain
  MOD_RES (3)..(3): Any amino acid comprising a large hydrophobic side chain
  MOD_RES (4)..(4): Any amino acid comprising an acidic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a hydroxyl-containing side chain
  MOD_RES (8)..(8): Any amino acid comprising a large hydrophobic side chain
  MOD_RES (9)..(9): Any amino acid comprising a large hydrophobic side chain
  MOD_RES (10)..(10): Any amino acid comprising a small hydrophobic side chain
XXXXXXXXXX

SEQ ID NO: 112 - protein, 19 aa, Artificial Sequence
  Description of Artificial Sequence: Synthetic peptide
DSKQEQCFHWDLESLLSCL

SEQ ID NO: 113 - protein, 14 aa, Artificial Sequence
  Description of Artificial Sequence: Synthetic peptide
DCMHWDLESLLACV

SEQ ID NO: 114 - protein, 14 aa, Artificial Sequence
  Description of Artificial Sequence: Synthetic peptide
DCIHWDLESLLRCV

SEQ ID NO: 115 - protein, 14 aa, Artificial Sequence
  Description of Artificial Sequence: Synthetic peptide
DCYHWDLESLLACL

SEQ ID NO: 116 - protein, 14 aa, Artificial Sequence
  Description of Artificial Sequence: Synthetic peptide
DCFHWDMESLLRCV

SEQ ID NO: 117 - protein, 14 aa, Artificial Sequence
  Description of Artificial Sequence: Synthetic peptide
ECMHWDLESLLACV

SEQ ID NO: 118 - protein, 20 aa, Artificial Sequence
  Description of Artificial Sequence: Synthetic peptide
EDFQGYQCFHWDIESLLSCI

SEQ ID NO: 119 - protein, 14 aa, Artificial Sequence
  Description of Artificial Sequence: Synthetic peptide
ECIHWDLESLLSCV

SEQ ID NO: 120 - protein, 20 aa, Artificial Sequence
  Description of Artificial Sequence: Synthetic peptide
FCMHWDMESLLACVQGAAMQ

SEQ ID NO: 121 - protein, 20 aa, Artificial Sequence
  Description of Artificial Sequence: Synthetic peptide
HCLHWDIETLMSCVYGNFEE

SEQ ID NO: 122 - protein, 20 aa, Artificial Sequence
  Description of Artificial Sequence: Synthetic peptide
HCNHWDFESLVSCVKDWSWS

SEQ ID NO: 123 - protein, 14 aa, Artificial Sequence
  Description of Artificial Sequence: Synthetic peptide
HCKHWDLESLLLCV

SEQ ID NO: 124 - protein, 20 aa, Artificial Sequence
  Description of Artificial Sequence: Synthetic peptide
HCKHWDIESLLSCVGIRLEP

SEQ ID NO: 125 - protein, 20 aa, Artificial Sequence
  Description of Artificial Sequence: Synthetic peptide
HCVHWDLESLLSCVNMQKLK

SEQ ID NO: 126 - protein, 20 aa, Artificial Sequence
  Description of Artificial Sequence: Synthetic peptide
HCIHWDLESLLACVQMHKGS

SEQ ID NO: 127 - protein, 20 aa, Artificial Sequence
  Description of Artificial Sequence: Synthetic peptide
HCMHWDMETLLECVRQWKIT

SEQ ID NO: 128 - protein, 20 aa, Artificial Sequence
  Description of Artificial Sequence: Synthetic peptide
HCIHWDLESLLSCVEDRRDR

SEQ ID NO: 129 - protein, 20 aa, Artificial Sequence
  Description of Artificial Sequence: Synthetic peptide
HCVHWDLESLLSCVNEPRFK

SEQ ID NO: 130 - protein, 20 aa, Artificial Sequence
  Description of Artificial Sequence: Synthetic peptide
HCNHWDLESLLSCVRNGAEQ

SEQ ID NO: 131 - protein, 20 aa, Artificial Sequence
  Description of Artificial Sequence: Synthetic peptide
HCIHWDLDSLLACVMGQRNQ

SEQ ID NO: 132 - protein, 20 aa, Artificial Sequence
  Description of Artificial Sequence: Synthetic peptide
HCMHSDMQTLFACMRDHIYA

SEQ ID NO: 133 - protein, 14 aa, Artificial Sequence
  Description of Artificial Sequence: Synthetic peptide
HCMHWDLESLLACV

SEQ ID NO: 134 - protein, 20 aa, Artificial Sequence
  Description of Artificial Sequence: Synthetic peptide
HCIHWDLESLLACVMGQRNQ

SEQ ID NO: 135 - protein, 20 aa, Artificial Sequence
  Description of Artificial Sequence: Synthetic peptide
HCVHWDLESLLDCVRRQPLK

SEQ ID NO: 136 - protein, 14 aa, Artificial Sequence
  Description of Artificial Sequence: Synthetic peptide
HCNHWDLESLLSCV

SEQ ID NO: 137 - protein, 14 aa, Artificial Sequence
  Description of Artificial Sequence: Synthetic peptide
HCFHWDLESLLACV

SEQ ID NO: 138 - protein, 14 aa, Artificial Sequence
  Description of Artificial Sequence: Synthetic peptide
HCIHWDMESLIACV

SEQ ID NO: 139 - protein, 14 aa, Artificial Sequence
  Description of Artificial Sequence: Synthetic peptide
HCVHWDLESLLSCV

SEQ ID NO: 140 - protein, 14 aa, Artificial Sequence
  Description of Artificial Sequence: Synthetic peptide
HCIHWDLDSLLSCV

SEQ ID NO: 141 - protein, 20 aa, Artificial Sequence
  Description of Artificial Sequence: Synthetic peptide
IHSSWAQCMHWDLESLISCV

SEQ ID NO: 142 - protein, 20 aa, Artificial Sequence
  Description of Artificial Sequence: Synthetic peptide
MGLQCTHWDFDSLMACKREL

SEQ ID NO: 143 - protein, 20 aa, Artificial Sequence
  Description of Artificial Sequence: Synthetic peptide
NCLHWDLESLLSCVSDLREG

SEQ ID NO: 144 - protein, 20 aa, Artificial Sequence
  Description of Artificial Sequence: Synthetic peptide
NMRHCLHWDMESLMACVNQW

SEQ ID NO: 145 - protein, 20 aa, Artificial Sequence
  Description of Artificial Sequence: Synthetic peptide
NCMHWDIESLLQCVRQIRDY

SEQ ID NO: 146 - protein, 20 aa, Artificial Sequence
  Description of Artificial Sequence: Synthetic peptide
QCVHWDLDTLFGCIREQLEL

SEQ ID NO: 147 - protein, 20 aa, Artificial Sequence
  Description of Artificial Sequence: Synthetic peptide
QGSRFTECMHWDIESLLSCI

SEQ ID NO: 148 - protein, 20 aa, Artificial Sequence
  Description of Artificial Sequence: Synthetic peptide
QCIHWDLESLLNCLRELKEP

SEQ ID NO: 149 - protein, 20 aa, Artificial Sequence
  Description of Artificial Sequence: Synthetic peptide
QCVHWDITTLLSCVKNLLDE

SEQ ID NO: 150 - protein, 14 aa, Artificial Sequence
  Description of Artificial Sequence: Synthetic peptide
QCFHWDFESLMSCV

SEQ ID NO: 151 - protein, 14 aa, Artificial Sequence
  Description of Artificial Sequence: Synthetic peptide
QCLHWDLESLLACV

SEQ ID NO: 152 - protein, 14 aa, Artificial Sequence
  Description of Artificial Sequence: Synthetic peptide
QCVHWDFESLLACV

SEQ ID NO: 153 - protein, 20 aa, Artificial Sequence
  Description of Artificial Sequence: Synthetic peptide
QMFGCIHWDLETLLMCVEKL

SEQ ID NO: 154 - protein, 20 aa, Artificial Sequence
  Description of Artificial Sequence: Synthetic peptide
QCIHWDLESLLSCVESERRL

SEQ ID NO: 155 - protein, 20 aa, Artificial Sequence
  Description of Artificial Sequence: Synthetic peptide
QGMNCSHWDLETLLDCMRTL

SEQ ID NO: 156 - protein, 14 aa, Artificial Sequence
  Description of Artificial Sequence: Synthetic peptide
QCIHWDIETLLSCV

SEQ ID NO: 157 - protein, 14 aa, Artificial Sequence
  Description of Artificial Sequence: Synthetic peptide
QCFHWDLESLLSCL

SEQ ID NO: 158 - protein, 20 aa, Artificial Sequence
  Description of Artificial Sequence: Synthetic peptide
QTMPCLHWDLESLLFCVKGL

SEQ ID NO: 159 - protein, 14 aa, Artificial Sequence
  Description of Artificial Sequence: Synthetic peptide
QCIHWDIETLLSCV

SEQ ID NO: 160 - protein, 14 aa, Artificial Sequence
  Description of Artificial Sequence: Synthetic peptide
QCLHWDLESLLACV

SEQ ID NO: 161 - protein, 14 aa, Artificial Sequence
  Description of Artificial Sequence: Synthetic peptide
QCVHWDLESLLYCV

SEQ ID NO: 162 - protein, 14 aa, Artificial Sequence
  Description of Artificial Sequence: Synthetic peptide
QCLHWDLESLLSCV

SEQ ID NO: 163 - protein, 14 aa, Artificial Sequence
  Description of Artificial Sequence: Synthetic peptide
QCLHWDLESLLSCV

SEQ ID NO: 164 - protein, 14 aa, Artificial Sequence
  Description of Artificial Sequence: Synthetic peptide
QCMHWDLESLLSCV

SEQ ID NO: 165 - protein, 14 aa, Artificial Sequence
  Description of Artificial Sequence: Synthetic peptide
QCLHWDLETLLACV

SEQ ID NO: 166 - protein, 20 aa, Artificial Sequence
  Description of Artificial Sequence: Synthetic peptide
RMYVRDQCISLDMDTFLSCL

SEQ ID NO: 167 - protein, 20 aa, Artificial Sequence
  Description of Artificial Sequence: Synthetic peptide
RRIHCMKWEFDTLMWCRGPQ

SEQ ID NO: 168 - protein, 20 aa, Artificial Sequence
  Description of Artificial Sequence: Synthetic peptide
RTRQCNHWDLESLLMCIQNL

SEQ ID NO: 169 - protein, 19 aa, Artificial Sequence
  Description of Artificial Sequence: Synthetic peptide
RLIQSPCMHWDLESLLLCV

SEQ ID NO: 170 - protein, 20 aa, Artificial Sequence
  Description of Artificial Sequence: Synthetic peptide
SAKVLKQCLHWDLESLLSCL

SEQ ID NO: 171 - protein, 20 aa, Artificial Sequence
  Description of Artificial Sequence: Synthetic peptide
SRRQCVKKDLGTFWSCFKAP

SEQ ID NO: 172 - protein, 20 aa, Artificial Sequence
  Description of Artificial Sequence: Synthetic peptide
SSSRLMQCMHWDLESLLQCV

SEQ ID NO: 173 - protein, 20 aa, Artificial Sequence
  Description of Artificial Sequence: Synthetic peptide
TVQPSSHCFHWDIDSLLSCL

SEQ ID NO: 174 - protein, 20 aa, Artificial Sequence
  Description of Artificial Sequence: Synthetic peptide
VRAQCMHWDLESLLSCVDRS

SEQ ID NO: 175 - protein, 19 aa, Artificial Sequence
  Description of Artificial Sequence: Synthetic peptide
WGTKAYCNHWDLESLLACV

SEQ ID NO: 176 - protein, 16 aa, Artificial Sequence
  Description of Artificial Sequence: Synthetic peptide
WGQCMHWDLESLLSCV

SEQ ID NO: 177 - protein, 20 aa, Artificial Sequence
  Description of Artificial Sequence: Synthetic peptide
YCMHWDLESLLWCVHRKELE

SEQ ID NO: 178 - protein, 20 aa, Artificial Sequence
  Description of Artificial Sequence: Synthetic peptide
YCPHFDIDSLLDCVRQSTWY

SEQ ID NO: 179 - protein, 14 aa, Artificial Sequence
  Description of Artificial Sequence: Synthetic peptide
YCFHWDLESLISCV

SEQ ID NO: 180 - protein, 20 aa, Artificial Sequence
  Description of Artificial Sequence: Synthetic peptide
YCAHWDLESLLSCVEGLSRS

SEQ ID NO: 181 - protein, 20 aa, Artificial Sequence
  Description of Artificial Sequence: Synthetic peptide
YCIHWDLESLLSCVSYNERH

SEQ ID NO: 182 - protein, 20 aa, Artificial Sequence
  Description of Artificial Sequence: Synthetic peptide
YCFHWDLETLMQCVAKGSNR

SEQ ID NO: 183 - protein, 14 aa, Artificial Sequence
  Description of Artificial Sequence: Synthetic peptide
YCMHWDLETLLACV

SEQ ID NO: 184 - protein, 28 aa, Artificial Sequence
  Description of Artificial Sequence: Synthetic peptide
  MOD_RES (1)..(1): Any amino acid
  MOD_RES (2)..(2): Any amino acid
  MOD_RES (3)..(3): Any amino acid
  MOD_RES (4)..(4): Any amino acid
  MOD_RES (5)..(5): Any amino acid
  MOD_RES (6)..(6): Any amino acid
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising a large hydrophobic side chain
  MOD_RES (11)..(11): Any amino acid comprising a large hydrophobic side chain or an amino acid comprising a small hydrophobic side chain
  MOD_RES (12)..(12): Any amino acid comprising a large hydrophobic side chain
  MOD_RES (13)..(13): Any amino acid comprising an acidic side chain
  MOD_RES (14)..(14): Any amino acid comprising a small hydrophobic side chain
  MOD_RES (15)..(15): Any amino acid comprising a small hydrophobic side chain
  MOD_RES (16)..(16): Any amino acid comprising a small hydrophobic side chain
  MOD_RES (17)..(17): Any amino acid comprising a large hydrophobic side chain
  MOD_RES (18)..(18): Any amino acid comprising a polar/neutral side chain
  MOD_RES (20)..(20): Any amino acid comprising a small hydrophobic side chain
  MOD_RES (21)..(21): Any amino acid comprising an aromatic side chain
  MOD_RES (22)..(22): Any amino acid comprising a large hydrophobic side chain
  MOD_RES (23)..(23): Any amino acid comprising a polar/neutral side chain
  MOD_RES (24)..(24): Any amino acid comprising a polar/neutral side chain
  MOD_RES (25)..(25): Any amino acid comprising an acidic side chain or an amino acid comprising a polar/neutral side chain
  MOD_RES (26)..(26): Any amino acid
  MOD_RES (27)..(27): Any amino acid
  MOD_RES (28)..(28): Any amino acid
XXXXXXXXXCXXXXXXXXCXXXXXXXXX

SEQ ID NO: 185 - protein, 16 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a small hydrophobic side chain
  MOD_RES (3)..(3): Any amino acid comprising a large hydrophobic side chain
  MOD_RES (5)..(5): Any amino acid comprising a large hydrophobic side chain and an amino acid comprising a small hydrophobic side chain
  MOD_RES (6)..(6): Any amino acid comprising a large hydrophobic side chain
  MOD_RES (7)..(7): Any amino acid comprising an acidic side chain
  MOD_RES (8)..(8): Any amino acid comprising a small hydrophobic side chain
  MOD_RES (9)..(9): Any amino acid comprising a small hydrophobic side chain
  MOD_RES (10)..(10): Any amino acid comprising a small hydrophobic side chain
  MOD_RES (11)..(11): Any amino acid comprising a large hydrophobic side chain
  MOD_RES (12)..(12): Any amino acid comprising a polar/neutral side chain
  MOD_RES (14)..(14): Any amino acid comprising a small hydrophobic side chain
  MOD_RES (15)..(15): Any amino acid comprising an aromatic side chain
  MOD_RES (16)..(16): Any amino acid comprising a large hydrophobic side chain
  MOD_RES (17)..(17): Any amino acid comprising a polar/neutral side chain
XXXCXXXXXXXXCXXX

SEQ ID NO: 186 - protein, 14 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid comprising a large hydrophobic side chain
  MOD_RES (4)..(4): Any amino acid comprising a large hydrophobic side chain and an amino acid comprising a small hydrophobic side chain
  MOD_RES (5)..(5): Any amino acid comprising a large hydrophobic side chain
  MOD_RES (6)..(6): Any amino acid comprising an acidic side chain
  MOD_RES (7)..(7): Any an amino acid comprising a small hydrophobic side chain
  MOD_RES (8)..(8): Any an amino acid comprising a small hydrophobic side chain
  MOD_RES (9)..(9): Any an amino acid comprising a small hydrophobic side chain
  MOD_RES (10)..(10): Any amino acid comprising a large hydrophobic side chain
  MOD_RES (11)..(11): Any amino acid comprising a polar/neutral side chain
  MOD_RES (13)..(13): Any amino acid comprising a small hydrophobic side chain
  MOD_RES (14)..(14): Any amino acid comprising an aromatic side chain
XXCXXXXXXXXCXX

SEQ ID NO: 187 - protein, 12 aa, Artificial Sequence
  Description of Artificial Sequence: Synthetic peptide
  MOD_RES (1)..(1): Any amino acid comprising a large hydrophobic side chain
  MOD_RES (3)..(3): Any amino acid comprising a large hydrophobic side chain and an amino acid comprising a small hydrophobic side chain
  MOD_RES (4)..(4): Any amino acid comprising a large hydrophobic side chain
  MOD_RES (5)..(5): Any amino acid comprising an acidic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid comprising a large hydrophobic side chain
  MOD_RES (10)..(10): Any amino acid comprising a polar/neutral side chain
  MOD_RES (12)..(12): Any amino acid comprising a small hydrophobic side chain
XCXXXXXXXXCX

SEQ ID NO: 188 - protein, 10 aa, Artificial Sequence
  Description of Artificial Sequence: Synthetic peptide
  MOD_RES (2)..(2): Any amino acid comprising a large hydrophobic side chain and an amino acid comprising a small hydrophobic side chain
  MOD_RES (3)..(3): Any amino acid comprising a large hydrophobic side chain
  MOD_RES (4)..(4): Any amino acid comprising an acidic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid comprising a large hydrophobic side chain
  MOD_RES (9)..(9): Any amino acid comprising a polar/neutral side chain
CXXXXXXXXC

SEQ ID NO: 189 - protein, 8 aa, Artificial Sequence
  Description of Artificial Sequence: Synthetic peptide
  MOD_RES (1)..(1): Any amino acid comprising a large hydrophobic side chain and an amino acid comprising a small hydrophobic side chain
  MOD_RES (2)..(2): Any amino acid comprising a large hydrophobic side chain
  MOD_RES (3)..(3): Any amino acid comprising an acidic side chain
  MOD_RES (4)..(4): Any amino acid comprising a small hydrophobic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a large hydrophobic side chain
  MOD_RES (8)..(8): Any amino acid comprising a polar/neutral side chain
XXXXXXXX

SEQ ID NO: 190 - protein, 22 aa, Artificial Sequence
  Description of Artificial Sequence: Synthetic peptide
ARHVPWCTLDPGSIQCAWLRAN

SEQ ID NO: 191 - protein, 22 aa, Artificial Sequence
  Description of Artificial Sequence: Synthetic peptide
AHYIPWCTLDPGSLQCAWLQSH

SEQ ID NO: 192 - protein, 22 aa, Artificial Sequence
  Description of Artificial Sequence: Synthetic peptide
DLSIPWCMLDPGSLQCSYITKF

SEQ ID NO: 193 - protein, 22 aa, Artificial Sequence
  Description of Artificial Sequence: Synthetic peptide
DRMVTGIPWCLLDPGSIQCAWL

SEQ ID NO: 194 - protein, 22 aa, Artificial Sequence
  Description of Artificial Sequence: Synthetic peptide
DMSIPWCNLDPGSLQCAWIRAN

SEQ ID NO: 195 - protein, 22 aa, Artificial Sequence
  Description of Artificial Sequence: Synthetic peptide
ENHWTRIPWCILDPGSIQCAWL

SEQ ID NO: 196 - protein, 22 aa, Artificial Sequence
  Description of Artificial Sequence: Synthetic peptide
ERRIPWCHLDPGSLQCAWLSRH

SEQ ID NO: 197 - protein, 22 aa, Artificial Sequence
  Description of Artificial Sequence: Synthetic peptide
EKRFVEIPWCTLDPGSLQCAYL

SEQ ID NO: 198 - protein, 22 aa, Artificial Sequence
  Description of Artificial Sequence: Synthetic peptide
EFRWSVIPWCTLDPGSVQCAWL

SEQ ID NO: 199 - protein, 22 aa, Artificial Sequence
  Description of Artificial Sequence: Synthetic peptide
ETRIPWCSLDPDSLQCAYLQAH

SEQ ID NO: 200 - protein, 21 aa, Artificial Sequence
  Description of Artificial Sequence: Synthetic peptide
EYLGRIPWCTLDPGSLQCAWL

SEQ ID NO: 201 - protein, 22 aa, Artificial Sequence
  Description of Artificial Sequence: Synthetic peptide
FVSIPWCSLDPGSLQCAWVTYN

SEQ ID NO: 202 - protein, 22 aa, Artificial Sequence
  Description of Artificial Sequence: Synthetic peptide
FTGVPWCLLDPGSLQCTWLKIG

SEQ ID NO: 203 - protein, 21 aa, Artificial Sequence
  Description of Artificial Sequence: Synthetic peptide
FVIPWCTLDPGGLQCAFIKGT

SEQ ID NO: 204 - protein, 22 aa, Artificial Sequence
  Description of Artificial Sequence: Synthetic peptide
HLGVPWCTLDPGSIQCAWLAKH

SEQ ID NO: 205 - protein, 21 aa, Artificial Sequence
  Description of Artificial Sequence: Synthetic peptide
HSWSEIPWCTLDPGSIQCAWI

SEQ ID NO: 206 - protein, 22 aa, Artificial Sequence
  Description of Artificial Sequence: Synthetic peptide
HFLGLTIPWCSLDPGSLQCAWI

SEQ ID NO: 207 - protein, 22 aa, Artificial Sequence
  Description of Artificial Sequence: Synthetic peptide
IRSCLWQPGALHCTWWAEEEPV

SEQ ID NO: 208 - protein, 22 aa, Artificial Sequence
  Description of Artificial Sequence: Synthetic peptide
IPWCTLDPGSLQCAWLQKFGEG

SEQ ID NO: 209 - protein, 22 aa, Artificial Sequence
  Description of Artificial Sequence: Synthetic peptide
IPWCILDPGSVQCAWLMQEKKE

SEQ ID NO: 210 - protein, 22 aa, Artificial Sequence
  Description of Artificial Sequence: Synthetic peptide
IPWCTLDPGSVQCDYLLKSAKQ

SEQ ID NO: 211 - protein, 22 aa, Artificial Sequence
  Description of Artificial Sequence: Synthetic peptide
IPWCTLDPGSLQCAWLTNTGAK

SEQ ID NO: 212 - protein, 22 aa, Artificial Sequence
  Description of Artificial Sequence: Synthetic peptide
IPWCTLDPGSLQCAWLQGKEER

SEQ ID NO: 213 - protein, 22 aa, Artificial Sequence
  Description of Artificial Sequence: Synthetic peptide
IGQVSRVPWCLLDPGSYQCGWL

SEQ ID NO: 214 - protein, 21 aa, Artificial Sequence
  Description of Artificial Sequence: Synthetic peptide
IQVPWCMLAPGSLQCAYITRH

SEQ ID NO: 215 - protein, 16 aa, Artificial Sequence
  Description of Artificial Sequence: Synthetic peptide
IPWCTLDPGSLQCAWL

SEQ ID NO: 216 - protein, 16 aa, Artificial Sequence
  Description of Artificial Sequence: Synthetic peptide
IPWCLLDPGGLQCVWL

SEQ ID NO: 217 - protein, 22 aa, Artificial Sequence
  Description of Artificial Sequence: Synthetic peptide
IPWCTLDPGSLQCAWLEERRSK

SEQ ID NO: 218 - protein, 22 aa, Artificial Sequence
  Description of Artificial Sequence: Synthetic peptide
IPWCMLDPGSVQCLWLATQENG

SEQ ID NO: 219 - protein, 16 aa, Artificial Sequence
  Description of Artificial Sequence: Synthetic peptide
IPWCSLDPGGLQCAWL

SEQ ID NO: 220 - protein, 16 aa, Artificial Sequence
  Description of Artificial Sequence: Synthetic peptide
IPWCSLDPGSLQCAWM

SEQ ID NO: 221 - protein, 22 aa, Artificial Sequence
  Description of Artificial Sequence: Synthetic peptide
IPWCTLDPGSLQCAWLSTQKVN

SEQ ID NO: 222 - protein, 16 aa, Artificial Sequence
  Description of Artificial Sequence: Synthetic peptide
IPWCTLDPGSIQCAWM

SEQ ID NO: 223 - protein, 16 aa, Artificial Sequence
  Description of Artificial Sequence: Synthetic peptide
IPWCMLDPGSIQCAWL

SEQ ID NO: 224 - protein, 16 aa, Artificial Sequence
  Description of Artificial Sequence: Synthetic peptide
IPWCKLDPGSIQCVWL

SEQ ID NO: 225 - protein, 16 aa, Artificial Sequence
  Description of Artificial Sequence: Synthetic peptide
IPWCKLDPGSLQCAYY

SEQ ID NO: 226 - protein, 16 aa, Artificial Sequence
  Description of Artificial Sequence: Synthetic peptide
IPWCTLDPGSLQCAWV

SEQ ID NO: 227 - protein, 16 aa, Artificial Sequence
  Description of Artificial Sequence: Synthetic peptide
IPWCTLDPGSLQCAWL

SEQ ID NO: 228 - protein, 16 aa, Artificial Sequence
  Description of Artificial Sequence: Synthetic peptide
IPWCMLDPGSLQCAWM

SEQ ID NO: 229 - protein, 16 aa, Artificial Sequence
  Description of Artificial Sequence: Synthetic peptide
IPWCTLDPGSFQCAWL

SEQ ID NO: 230 - protein, 16 aa, Artificial Sequence
  Description of Artificial Sequence: Synthetic peptide
IPWCILDPGSVQCAFL

SEQ ID NO: 231 - protein, 22 aa, Artificial Sequence
  Description of Artificial Sequence: Synthetic peptide
IPWCTLDPGSLQCAWLQKFGEG

SEQ ID NO: 232 - protein, 22 aa, Artificial Sequence
  Description of Artificial Sequence: Synthetic peptide
IPWCALDPGSLQCAWLRSHGSE

SEQ ID NO: 233 - protein, 16 aa, Artificial Sequence
  Description of Artificial Sequence: Synthetic peptide
IPWCTLDPGSLQCAYL

SEQ ID NO: 234 - protein, 22 aa, Artificial Sequence
  Description of Artificial Sequence: Synthetic peptide
INWCLLDPGSLQCAWIRGDGHG

SEQ ID NO: 235 - protein, 22 aa, Artificial Sequence
  Description of Artificial Sequence: Synthetic peptide
INWCLLDPGSLQCAWIRGDGHG

SEQ ID NO: 236 - protein, 16 aa, Artificial Sequence
  Description of Artificial Sequence: Synthetic peptide
IPWCSLDPGSLQCAFY

SEQ ID NO: 237 - protein, 22 aa, Artificial Sequence
  Description of Artificial Sequence: Synthetic peptide
IPWCTLDPGSIQCAFLQDMTSK

SEQ ID NO: 238 - protein, 22 aa, Artificial Sequence
  Description of Artificial Sequence: Synthetic peptide
IPWCTLDPGSIQCAWLQRDPDL

SEQ ID NO: 239 - protein, 22 aa, Artificial Sequence
  Description of Artificial Sequence: Synthetic peptide
IPWCTLDPGSIQCGWLKIQDKL

SEQ ID NO: 240 - protein, 22 aa, Artificial Sequence
  Description of Artificial Sequence: Synthetic peptide
IPWCTLDPGSIQCVWVKEHLTR

SEQ ID NO: 241 - protein, 22 aa, Artificial Sequence
  Description of Artificial Sequence: Synthetic peptide
IPWCLLDPGSLQCSYLKEAAEP

SEQ ID NO: 242 - protein, 22 aa, Artificial Sequence
  Description of Artificial Sequence: Synthetic peptide
IPWCRLDPGSLQCLWQMRHAEN

SEQ ID NO: 243 - protein, 22 aa, Artificial Sequence
  Description of Artificial Sequence: Synthetic peptide
IPWCTLDPGSLQCAFILGKTNS

SEQ ID NO: 244 - protein, 22 aa, Artificial Sequence
  Description of Artificial Sequence: Synthetic peptide
IPWCALDPGSVQCAWLRRRGQR

SEQ ID NO: 245 - protein, 22 aa, Artificial Sequence
  Description of Artificial Sequence: Synthetic peptide
IPWCLLDPGSVQCAYSKQGERA

SEQ ID NO: 246 - protein, 22 aa, Artificial Sequence
  Description of Artificial Sequence: Synthetic peptide
IPWCTLDPGSVQCTWMKGQRAR

SEQ ID NO: 247 - protein, 22 aa, Artificial Sequence
  Description of Artificial Sequence: Synthetic peptide
KAGSWFIPWCTLDPGSLQCAFL

SEQ ID NO: 248 - protein, 22 aa, Artificial Sequence
  Description of Artificial Sequence: Synthetic peptide
KRRDSVIPWCLLDPGSLQCTWL

SEQ ID NO: 249 - protein, 22 aa, Artificial Sequence
  Description of Artificial Sequence: Synthetic peptide
KRRIPWCSLDPGSLQCAYLERT

SEQ ID NO: 250 - protein, 22 aa, Artificial Sequence
  Description of Artificial Sequence: Synthetic peptide
KTRIPWCTLDPGSIQCAWFMLY

SEQ ID NO: 251 - protein, 22 aa, Artificial Sequence
  Description of Artificial Sequence: Synthetic peptide
LPWCTDHPGGQQCWWLEDREKR

SEQ ID NO: 252 - protein, 22 aa, Artificial Sequence
  Description of Artificial Sequence: Synthetic peptide
LTSVPWCTLDPGSLQCAWLSRQ

SEQ ID NO: 253 - protein, 22 aa, Artificial Sequence
  Description of Artificial Sequence: Synthetic peptide
MGGIPWCSLDPGSIQCAFLKKG

SEQ ID NO: 254 - protein, 22 aa, Artificial Sequence
  Description of Artificial Sequence: Synthetic peptide
MQGGLGIPWCMLDPGSLQCLWL

SEQ ID NO: 255 - protein, 22 aa, Artificial Sequence
  Description of Artificial Sequence: Synthetic peptide
METIPWCTLDPGSLQCHWITSS

SEQ ID NO: 256 - protein, 22 aa, Artificial Sequence
  Description of Artificial Sequence: Synthetic peptide
MIHVPWCQLDPGGLQCAWLNDI

SEQ ID NO: 257 - protein, 23 aa, Artificial Sequence
  Description of Artificial Sequence: Synthetic peptide
MCNSCFVPWCSLDPGSLQCAWLR

SEQ ID NO: 258 - protein, 22 aa, Artificial Sequence
  Description of Artificial Sequence: Synthetic peptide
NPFRSVVPWCALDPGSLQCAWL

SEQ ID NO: 259 - protein, 22 aa, Artificial Sequence
  Description of Artificial Sequence: Synthetic peptide
NRMIPWCELWPGSIQCAWITDL

SEQ ID NO: 260 - protein, 22 aa, Artificial Sequence
  Description of Artificial Sequence: Synthetic peptide
NWSRSDVPWCTLDPGSIQCAFL

SEQ ID NO: 261 - protein, 22 aa, Artificial Sequence
  Description of Artificial Sequence: Synthetic peptide
NQQVPWCSLDPGGLQCEWLKNR

SEQ ID NO: 262 - protein, 22 aa, Artificial Sequence
  Description of Artificial Sequence: Synthetic peptide
QMQVPWCSLDPGSLQCAWMNNY

SEQ ID NO: 263 - protein, 22 aa, Artificial Sequence
  Description of Artificial Sequence: Synthetic peptide
QWVVPWCMLDPGSLQCEWLKAN

SEQ ID NO: 264 - protein, 22 aa, Artificial Sequence
  Description of Artificial Sequence: Synthetic peptide
QAGWRGDFWCSLDPGSQRCVRW

SEQ ID NO: 265 - protein, 22 aa, Artificial Sequence
  Description of Artificial Sequence: Synthetic peptide
QNKVPWCLLDPGSLQCAWLRSN

SEQ ID NO: 266 - protein, 22 aa, Artificial Sequence
  Description of Artificial Sequence: Synthetic peptide
QTVVPWCTLDPGSLQCAWLSRQ

SEQ ID NO: 267 - protein, 22 aa, Artificial Sequence
  Description of Artificial Sequence: Synthetic peptide
QTLVPWCSLDPGSLQCTWLLKA

SEQ ID NO: 268 - protein, 22 aa, Artificial Sequence
  Description of Artificial Sequence: Synthetic peptide
QHRIPWCALDPGGIQCAYLHRQ

SEQ ID NO: 269 - protein, 22 aa, Artificial Sequence
  Description of Artificial Sequence: Synthetic peptide
RHFDDIIPWCTLDPGSLQCAYL

SEQ ID NO: 270 - protein, 22 aa, Artificial Sequence
  Description of Artificial Sequence: Synthetic peptide
RVQMSFIPWCILDPGSLQCAWL

SEQ ID NO: 271 - protein, 22 aa, Artificial Sequence
  Description of Artificial Sequence: Synthetic peptide
RDWTSGIPWCVLDPGSLQCQFL

SEQ ID NO: 272 - protein, 22 aa, Artificial Sequence
  Description of Artificial Sequence: Synthetic peptide
RFSVTSVPWCLLDPGSLQCEFL

SEQ ID NO: 273 - protein, 22 aa, Artificial Sequence
  Description of Artificial Sequence: Synthetic peptide
RSAVPWCTLDPGSIQCAYLRNQ

SEQ ID NO: 274 - protein, 22 aa, Artificial Sequence
  Description of Artificial Sequence: Synthetic peptide
RWIDTVIPWCSLDPGGLQCLWL

SEQ ID NO: 275 - protein, 22 aa, Artificial Sequence
  Description of Artificial Sequence: Synthetic peptide
RREIPWCTLDPGGLQCSWLRSI

SEQ ID NO: 276 - protein, 22 aa, Artificial Sequence
  Description of Artificial Sequence: Synthetic peptide
RNPIPWCTLDPGGLQCAWLEEH

SEQ ID NO: 277 - protein, 22 aa, Artificial Sequence
  Description of Artificial Sequence: Synthetic peptide
RNAIPWCDLDPGSLQCAYLRKH

SEQ ID NO: 278 - protein, 17 aa, Artificial Sequence
  Description of Artificial Sequence: Synthetic peptide
RPVVCATLPGGYVCRVT

SEQ ID NO: 279 - protein, 22 aa, Artificial Sequence
  Description of Artificial Sequence: Synthetic peptide
SLTVPWCTLDPGSMQCAWLQNR

SEQ ID NO: 280 - protein, 22 aa, Artificial Sequence
  Description of Artificial Sequence: Synthetic peptide
SGKWGDIPWCTLDPGSIQCAWL

SEQ ID NO: 281 - protein, 22 aa, Artificial Sequence
  Description of Artificial Sequence: Synthetic peptide
SEMGESIPWCQLDPGSVQCAWL

SEQ ID NO: 282 - protein, 22 aa, Artificial Sequence
  Description of Artificial Sequence: Synthetic peptide
SNIVPWCTLDPGGLQCAWIMGR

SEQ ID NO: 283 - protein, 22 aa, Artificial Sequence
  Description of Artificial Sequence: Synthetic peptide
SRRIPWCTLDPGSLQCAWLRHQ

SEQ ID NO: 284 - protein, 22 aa, Artificial Sequence
  Description of Artificial Sequence: Synthetic peptide
STNHGQIPWCTLDPGSLQCTWL

SEQ ID NO: 285 - protein, 22 aa, Artificial Sequence
  Description of Artificial Sequence: Synthetic peptide
SWSVPWCTLDPGSMQCVWLQMQ

SEQ ID NO: 286 - protein, 22 aa, Artificial Sequence
  Description of Artificial Sequence: Synthetic peptide
TTEIQDIPWCELDPGSLQCAYM

SEQ ID NO: 287 - protein, 22 aa, Artificial Sequence
  Description of Artificial Sequence: Synthetic peptide
TSRVPGCSLDPGSLQCAWLRHF

SEQ ID NO: 288 - protein, 16 aa, Artificial Sequence
  Description of Artificial Sequence: Synthetic peptide
VPWCMLDPGSMQCAWL

SEQ ID NO: 289 - protein, 22 aa, Artificial Sequence
  Description of Artificial Sequence: Synthetic peptide
VDWCILDPGSLQCSWLKNMWNK

SEQ ID NO: 290 - protein, 22 aa, Artificial Sequence
  Description of Artificial Sequence: Synthetic peptide
VPWCELDPGGLQCSYLRGWVTD

SEQ ID NO: 291 - protein, 21 aa, Artificial Sequence
  Description of Artificial Sequence: Synthetic peptide
VLETQVPWCTLDPGSIQCAWL

SEQ ID NO: 292 - protein, 22 aa, Artificial Sequence
  Description of Artificial Sequence: Synthetic peptide
VPWCILDPGSVQCAWLRDNQVW

SEQ ID NO: 293 - protein, 16 aa, Artificial Sequence
  Description of Artificial Sequence: Synthetic peptide
VPWCTLDPGSYQCAWL

SEQ ID NO: 294 - protein, 22 aa, Artificial Sequence
  Description of Artificial Sequence: Synthetic peptide
VGSTMRIPWCSLDPGSLQCEYL

SEQ ID NO: 295 - protein, 22 aa, Artificial Sequence
  Description of Artificial Sequence: Synthetic peptide
VHRIPWCTLDPGGLQCAWLRQM

SEQ ID NO: 296 - protein, 16 aa, Artificial Sequence
  Description of Artificial Sequence: Synthetic peptide
VPWCTLDPGSLQCKWL

SEQ ID NO: 297 - protein, 22 aa, Artificial Sequence
  Description of Artificial Sequence: Synthetic peptide
VPWCRLDPGSIQCAYLRSEQKS

SEQ ID NO: 298 - protein, 22 aa, Artificial Sequence
  Description of Artificial Sequence: Synthetic peptide
VAGVPWCSLDPGSLQCHWLNEH

SEQ ID NO: 299 - protein, 22 aa, Artificial Sequence
  Description of Artificial Sequence: Synthetic peptide
VPWCTLDPGSIQCAYLKNQVDG

SEQ ID NO: 300 - protein, 22 aa, Artificial Sequence
  Description of Artificial Sequence: Synthetic peptide
VRYVPWCTLDPGSIQCAYLQEQ

SEQ ID NO: 301 - protein, 22 aa, Artificial Sequence
  Description of Artificial Sequence: Synthetic peptide
VPWCNLDPGGLQCEWLTRVLGR

SEQ ID NO: 302 - protein, 22 aa, Artificial Sequence
  Description of Artificial Sequence: Synthetic peptide
VPWCMLDPGSLQCSWLQQTFSN

SEQ ID NO: 303 - protein, 16 aa, Artificial Sequence
  Description of Artificial Sequence: Synthetic peptide
VPWCTLDPGGIQCAWL

SEQ ID NO: 304 - protein, 16 aa, Artificial Sequence
  Description of Artificial Sequence: Synthetic peptide
VPWCTLDPGSIQCHWL

SEQ ID NO: 305 - protein, 16 aa, Artificial Sequence
  Description of Artificial Sequence: Synthetic peptide
VPWCTLDPGSFQCAWL

SEQ ID NO: 306 - protein, 22 aa, Artificial Sequence
  Description of Artificial Sequence: Synthetic peptide
VPWCLLDPGSVQCAFLNRQKED

SEQ ID NO: 307 - protein, 16 aa, Artificial Sequence
  Description of Artificial Sequence: Synthetic peptide
VPWCMLDPGSLQCMYL

SEQ ID NO: 308 - protein, 16 aa, Artificial Sequence
  Description of Artificial Sequence: Synthetic peptide
VPWCMLDPGSIQCAFL

SEQ ID NO: 309 - protein, 22 aa, Artificial Sequence
  Description of Artificial Sequence: Synthetic peptide
VPWCTLDPGGLQCAWMRGTYSQ

SEQ ID NO: 310 - protein, 22 aa, Artificial Sequence
  Description of Artificial Sequence: Synthetic peptide
VPWCRLDPGSVQCAWLRSRNNV

SEQ ID NO: 311 - protein, 16 aa, Artificial Sequence
  Description of Artificial Sequence: Synthetic peptide
VPWCALDPGSVQCAFL

SEQ ID NO: 312 - protein, 16 aa, Artificial Sequence
  Description of Artificial Sequence: Synthetic peptide
VPWCMLDPGSLQCMYL

SEQ ID NO: 313 - protein, 16 aa, Artificial Sequence
  Description of Artificial Sequence: Synthetic peptide
VPWCTLDPGSLQCAWF

SEQ ID NO: 314 - protein, 16 aa, Artificial Sequence
  Description of Artificial Sequence: Synthetic peptide
VPWCILDPGSLQCAYL

SEQ ID NO: 315 - protein, 16 aa, Artificial Sequence
  Description of Artificial Sequence: Synthetic peptide
VPWCHLDPGGIQCAYL

SEQ ID NO: 316 - protein, 22 aa, Artificial Sequence
  Description of Artificial Sequence: Synthetic peptide
VPWCSLDPGSLQCHWQVSRGWH

SEQ ID NO: 317 - protein, 22 aa, Artificial Sequence
  Description of Artificial Sequence: Synthetic peptide
VPWCELDPGSLQCAWLQTWGVN

SEQ ID NO: 318 - protein, 22 aa, Artificial Sequence
  Description of Artificial Sequence: Synthetic peptide
VPWCKIDPGSLQCAYLKRHQIL

SEQ ID NO: 319 - protein, 22 aa, Artificial Sequence
  Description of Artificial Sequence: Synthetic peptide
VPWCKLDPGSFQCAFLRELERQ

SEQ ID NO: 320 - protein, 22 aa, Artificial Sequence
  Description of Artificial Sequence: Synthetic peptide
VPWCLLDPGSLQCAWLKRMEVD

SEQ ID NO: 321 - protein, 22 aa, Artificial Sequence
  Description of Artificial Sequence: Synthetic peptide
VPWCLLDPGSLQCAWMRSGEGK

SEQ ID NO: 322 - protein, 22 aa, Artificial Sequence
  Description of Artificial Sequence: Synthetic peptide
VPWCLLDPGSLQCAYLEGKWDL

SEQ ID NO: 323 - protein, 22 aa, Artificial Sequence
  Description of Artificial Sequence: Synthetic peptide
VPWCMLDPGSIQCAWINEQNML

SEQ ID NO: 324 - protein, 22 aa, Artificial Sequence
  Description of Artificial Sequence: Synthetic peptide
VPWCMLDPGSLQCAWMRSQREE

SEQ ID NO: 325 - protein, 22 aa, Artificial Sequence
  Description of Artificial Sequence: Synthetic peptide
VPWCTIDPGSLQCTWLRVHRGE

SEQ ID NO: 326 - protein, 22 aa, Artificial Sequence
  Description of Artificial Sequence: Synthetic peptide
VPWCTLDPGSLQCAWLEKESRT

SEQ ID NO: 327 - protein, 22 aa, Artificial Sequence
  Description of Artificial Sequence: Synthetic peptide
VPWCTLDPGSLQCAWLISNARE

SEQ ID NO: 328 - protein, 22 aa, Artificial Sequence
  Description of Artificial Sequence: Synthetic peptide
VPWCTLDPGSLQCAWLKIQEAL

SEQ ID NO: 329 - protein, 22 aa, Artificial Sequence
  Description of Artificial Sequence: Synthetic peptide
VPWCTLDPGSLQCAWLKKHEGG

SEQ ID NO: 330 - protein, 22 aa, Artificial Sequence
  Description of Artificial Sequence: Synthetic peptide
VPWCTLDPGSLQCAWLNNHRSR

SEQ ID NO: 331 - protein, 22 aa, Artificial Sequence
  Description of Artificial Sequence: Synthetic peptide
VPWCTLDPGSLQCDWLMKRRNT

SEQ ID NO: 332 - protein, 22 aa, Artificial Sequence
  Description of Artificial Sequence: Synthetic peptide
VPWCTLDPGSLQCDYLKWMNMR

SEQ ID NO: 333 - protein, 22 aa, Artificial Sequence
  Description of Artificial Sequence: Synthetic peptide
VPWCTLDPGSLQCHWLLSRSDN

SEQ ID NO: 334 - protein, 22 aa, Artificial Sequence
  Description of Artificial Sequence: Synthetic peptide
VPWCTLDPGSVQCAYLKARRPS

SEQ ID NO: 335 - protein, 22 aa, Artificial Sequence
  Description of Artificial Sequence: Synthetic peptide
VPWCVLDPGSIQCEYLQRLHRQ

SEQ ID NO: 336 - protein, 22 aa, Artificial Sequence
  Description of Artificial Sequence: Synthetic peptide
WRRVPWCTLDPGSLQCAWLNSH

SEQ ID NO: 337 - protein, 21 aa, Artificial Sequence
  Description of Artificial Sequence: Synthetic peptide
WGIPWCTLDPGSLQCAWLGKH

SEQ ID NO: 338 - protein, 22 aa, Artificial Sequence
  Description of Artificial Sequence: Synthetic peptide
WTQIPWCTLDPGSIQCSWLSRE

SEQ ID NO: 339 - protein, 22 aa, Artificial Sequence
  Description of Artificial Sequence: Synthetic peptide
WVTIPWCILDPGSLQCEWQTKV

SEQ ID NO: 340 - protein, 22 aa, Artificial Sequence
  Description of Artificial Sequence: Synthetic peptide
WTQVPWCTLDPGSLQCDWLSKR

SEQ ID NO: 341 - protein, 22 aa, Artificial Sequence
  Description of Artificial Sequence: Synthetic peptide
WERDSEIPWCTLDPGSLQCAWL

SEQ ID NO: 342 - protein, 22 aa, Artificial Sequence
  Description of Artificial Sequence: Synthetic peptide
WFEIPWCTLDPGSLQCEWSMQN

SEQ ID NO: 343 - protein, 22 aa, Artificial Sequence
  Description of Artificial Sequence: Synthetic peptide
WRQTLQIPWCSLDPGSLQCAYL

SEQ ID NO: 344 - protein, 22 aa, Artificial Sequence
  Description of Artificial Sequence: Synthetic peptide
YSGRREIPWCTLDPGSLQCTWL

SEQ ID NO: 345 - protein, 22 aa, Artificial Sequence
  Description of Artificial Sequence: Synthetic peptide
YRSGHGIPWCMLDPGGLQCSWL

SEQ ID NO: 346 - protein, 22 aa, Artificial Sequence
  Description of Artificial Sequence: Synthetic peptide
YKGVSEIPWCVLDPGSVQCAYL

SEQ ID NO: 347 - protein, 22 aa, Artificial Sequence
  Description of Artificial Sequence: Synthetic peptide
YKYIPWCTLDPGSLQCAWLARN

SEQ ID NO: 348 - protein, 22 aa, Artificial Sequence
  Description of Artificial Sequence: Synthetic peptide
YQPVPWCTLDPGSLQCAWLSNI

SEQ ID NO: 349 - protein, 22 aa, Artificial Sequence
  Description of Artificial Sequence: Synthetic peptide
YNFVPWCMLDPGSLQCAYLRKT

SEQ ID NO: 350 - protein, 22 aa, Artificial Sequence
  Description of Artificial Sequence: Synthetic peptide
  MOD_RES (1)..(1): Any amino acid
  MOD_RES (2)..(2): Any amino acid
  MOD_RES (3)..(3): Any amino acid
  MOD_RES (4)..(4): Any amino acid comprising a basic side chain
  MOD_RES (5)..(5): Any amino acid comprising a large hydrophobic side chain
  MOD_RES (6)..(6): Any amino acid comprising an acidic side chain or an amino acid comprising a large hydrophobic side chain
  MOD_RES (8)..(8): Any amino acid comprising a small hydrophobic side chain
  MOD_RES (9)..(9): Any amino acid comprising an acidic side chain
  MOD_RES (10)..(10): Any amino acid comprising a large hydrophobic side chain
  MOD_RES (11)..(11): Any amino acid comprising a small hydrophobic side chain
  MOD_RES (12)..(12): Any amino acid comprising a small hydrophobic side chain
  MOD_RES (13)..(13): Any amino acid comprising a small hydrophobic side chain
  MOD_RES (14)..(14): Any amino acid comprising a basic side chain or an amino acid comprising a large hydrophobic side chain
  MOD_RES (15)..(15): Any amino acid comprising a polar/neutral side chain or a large hydrophobic side chain
  MOD_RES (17)..(17): Any amino acid comprising a basic side chain
  MOD_RES (18)..(18): Any amino acid comprising a large hydrophobic side chain
  MOD_RES (19)..(19): Any amino acid comprising a basic side chain
  MOD_RES (20)..(20): Any amino acid
  MOD_RES (21)..(21): Any amino acid
  MOD_RES (22)..(22): Any amino acid
XXXXXXCXXXXXXXXCXXXXXX

SEQ ID NO: 351 - protein, 16 aa, Artificial Sequence
  Description of Artificial Sequence: Synthetic peptide
  MOD_RES (1)..(1): Any amino acid comprising a basic side chain
  MOD_RES (2)..(2): Any amino acid comprising a large hydrophobic side chain
  MOD_RES (3)..(3): Any amino acid comprising an acidic side chain or an amino acid comprising a large hydrophobic side chain
  MOD_RES (5)..(5): Any amino acid comprising a small hydrophobic side chain
  MOD_RES (6)..(6): Any amino acid comprising an acidic side chain
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising a small hydrophobic side chain
  MOD_RES (10)..(10): Any amino acid comprising a small hydrophobic side chain
  MOD_RES (11)..(11): Any amino acid comprising a basic side chain or an amino acid comprising a large hydrophobic side chain
  MOD_RES (12)..(12): Any amino acid comprising a polar/neutral side chain or a large hydrophobic side chain
  MOD_RES (14)..(14): Any amino acid comprising a basic side chain
  MOD_RES (15)..(15): Any amino acid comprising a large hydrophobic side chain
  MOD_RES (16)..(16): Any amino acid comprising a basic side chain
XXXCXXXXXXXXCXXX

SEQ ID NO: 352 - protein, 14 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising an acidic side chain or an amino acid comprising a large hydrophobic side chain
  MOD_RES (4)..(4): Any amino acid comprising a small hydrophobic side chain
  MOD_RES (5)..(5): Any amino acid comprising an acidic side chain
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid comprising a small hydrophobic side chain
  MOD_RES (10)..(10): Any amino acid comprising a basic side chain or an amino acid comprising a large hydrophobic side chain
  MOD_RES (11)..(11): Any amino acid comprising a polar/neutral side chain or a large hydrophobic side chain
  MOD_RES (13)..(13): Any amino acid comprising a basic side chain
  MOD_RES (14)..(14): Any amino acid comprising a large hydrophobic side chain
XXCXXXXXXXXCXX

SEQ ID NO: 353 - protein, 12 aa, Artificial Sequence
  Description of Artificial Sequence: Synthetic peptide
  MOD_RES (1)..(1): Any amino acid comprising an acidic side chain or an amino acid comprising a large hydrophobic side chain
  MOD_RES (3)..(3): Any amino acid comprising a small hydrophobic side chain
  MOD_RES (4)..(4): Any amino acid comprising an acidic side chain
  MOD_RES (5)..(5): Any amino acid comprising a large hydrophobic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid comprising a basic side chain or an amino acid comprising a large hydrophobic side chain
  MOD_RES (10)..(10): Any amino acid comprising a polar/neutral side chain or a large hydrophobic side chain
  MOD_RES (12)..(12): Any amino acid comprising a basic side chain
XCXXXXXXXXCX

SEQ ID NO: 354 - protein, 10 aa, Artificial Sequence
  Description of Artificial Sequence: Synthetic peptide
  MOD_RES (2)..(2): Any amino acid comprising a small hydrophobic side chain
  MOD_RES (3)..(3): Any amino acid comprising an acidic side chain
  MOD_RES (4)..(4): Any amino acid comprising a large hydrophobic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid comprising a basic side chain or an amino acid comprising a large hydrophobic side chain
  MOD_RES (9)..(9): Any amino acid comprising a polar/neutral side chain or a large hydrophobic side chain
CXXXXXXXXC

SEQ ID NO: 355 - protein, 8 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid comprising an acidic side chain
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a basic side chain or an amino acid comprising a large hydrophobic side chain
  MOD_RES (8)..(8): Any amino acid comprising a polar/neutral side chain or a large hydrophobic side chain
XXXXXXXX

SEQ ID NO: 356 - protein, 20 aa, Artificial Sequence
  Description of Artificial Sequence: Synthetic peptide
FRLECADLPGGRNCRLRTSG

SEQ ID NO: 357 - protein, 16 aa, Artificial Sequence
  Description of Artificial Sequence: Synthetic peptide
ILECAELPGGRHCRLR

SEQ ID NO: 358 - protein, 22 aa, Artificial Sequence
  Description of Artificial Sequence: Synthetic peptide
KGVRLYCADLPGGRICRSGKVE

SEQ ID NO: 359 - protein, 22 aa, Artificial Sequence
  Description of Artificial Sequence: Synthetic peptide
LRLLQYCADLPGGFNCRVREDL

SEQ ID NO: 360 - protein, 16 aa, Artificial Sequence
  Description of Artificial Sequence: Synthetic peptide
PVECAEFPGGRVCRLR

SEQ ID NO: 361 - protein, 16 aa, Artificial Sequence
  Description of Artificial Sequence: Synthetic peptide
QIDCADLPGGHVCRLR

SEQ ID NO: 362 - protein, 16 aa, Artificial Sequence
  Description of Artificial Sequence: Synthetic peptide
RVECAQLPGGKVCRLR

SEQ ID NO: 363 - protein, 22 aa, Artificial Sequence
  Description of Artificial Sequence: Synthetic peptide
RGCRLDCADLPGGHTCRCRSAD

SEQ ID NO: 364 - protein, 16 aa, Artificial Sequence
  Description of Artificial Sequence: Synthetic peptide
RIECADLPGGHVCRLR

SEQ ID NO: 365 - protein, 22 aa, Artificial Sequence
  Description of Artificial Sequence: Synthetic peptide
RKMHLECADLPGGRHCRLRHEM

SEQ ID NO: 366 - protein, 22 aa, Artificial Sequence
  Description of Artificial Sequence: Synthetic peptide
RNGRIECADLPGGFVCRMRDMD

SEQ ID NO: 367 - protein, 22 aa, Artificial Sequence
  Description of Artificial Sequence: Synthetic peptide
RDVRLECADLPGGHVCRLRDSR

SEQ ID NO: 368 - protein, 22 aa, Artificial Sequence
  Description of Artificial Sequence: Synthetic peptide
RKARIDCAELPGGRQCRLHGWS

SEQ ID NO: 369 - protein, 16 aa, Artificial Sequence
  Description of Artificial Sequence: Synthetic peptide
RVECAQLPGGKVCRMR

SEQ ID NO: 370 - protein, 16 aa, Artificial Sequence
  Description of Artificial Sequence: Synthetic peptide
RVECAELPGGFVCRLR

SEQ ID NO: 371 - protein, 16 aa, Artificial Sequence
  Description of Artificial Sequence: Synthetic peptide
RVYCADLPGGRQCRSH

SEQ ID NO: 372 - protein, 16 aa, Artificial Sequence
  Description of Artificial Sequence: Synthetic peptide
RIYCAELPGGQVCRSR

SEQ ID NO: 373 - protein, 22 aa, Artificial Sequence
  Description of Artificial Sequence: Synthetic peptide
RREPVYCADLPGGLHCRVRVSE

SEQ ID NO: 374 - protein, 16 aa, Artificial Sequence
  Description of Artificial Sequence: Synthetic peptide
RLECADLPGGRACRLR

SEQ ID NO: 375 - protein, 16 aa, Artificial Sequence
  Description of Artificial Sequence: Synthetic peptide
RVYCADLPGGRQCRSH

SEQ ID NO: 376 - protein, 16 aa, Artificial Sequence
  Description of Artificial Sequence: Synthetic peptide
RVYCAELPGGLACRGR

SEQ ID NO: 377 - protein, 22 aa, Artificial Sequence
  Description of Artificial Sequence: Synthetic peptide
RNGRVYCADLPGGRQCRSWGAI

SEQ ID NO: 378 - protein, 16 aa, Artificial Sequence
  Description of Artificial Sequence: Synthetic peptide
RLECANLPGGFNCRLR

SEQ ID NO: 379 - protein, 16 aa, Artificial Sequence
  Description of Artificial Sequence: Synthetic peptide
RLECADLPGGRHCRLR

SEQ ID NO: 380 - protein, 16 aa, Artificial Sequence
  Description of Artificial Sequence: Synthetic peptide
RLECAKLPGGFNCRLR

SEQ ID NO: 381 - protein, 16 aa, Artificial Sequence
  Description of Artificial Sequence: Synthetic peptide
RIECAELPGGFTCRLR

SEQ ID NO: 382 - protein, 16 aa, Artificial Sequence
  Description of Artificial Sequence: Synthetic peptide
RIYCESLPGGFNCRLR

SEQ ID NO: 383 - protein, 16 aa, Artificial Sequence
  Description of Artificial Sequence: Synthetic peptide
RVYCAELPGGLACRLR

SEQ ID NO: 384 - protein, 16 aa, Artificial Sequence
  Description of Artificial Sequence: Synthetic peptide
RYECADLPGGLHCEFR

SEQ ID NO: 385 - protein, 16 aa, Artificial Sequence
  Description of Artificial Sequence: Synthetic peptide
RVECAELPGGFHCRLR

SEQ ID NO: 386 - protein, 16 aa, Artificial Sequence
  Description of Artificial Sequence: Synthetic peptide
RVECADLPGGRVCKSR

SEQ ID NO: 387 - protein, 16 aa, Artificial Sequence
  Description of Artificial Sequence: Synthetic peptide
RVECADLPGGLACRLR

SEQ ID NO: 388 - protein, 22 aa, Artificial Sequence
  Description of Artificial Sequence: Synthetic peptide
TFRRVYCQELPGGLVCRAHSQD

SEQ ID NO: 389 - protein, 16 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a small hydrophobic side chain or cysteine
  MOD_RES (3)..(3): Any amino acid comprising a large hydrophobic side chain
  MOD_RES (4)..(4): Any amino acid comprising a basic side chain or cysteine
  MOD_RES (5)..(5): Any amino acid comprising a large hydrophobic side chain or an amino acid comprising small hydrophobic side chain
  MOD_RES (6)..(6): Any amino acid comprising a large hydrophobic side chain or an amino acid comprising an acidic side chain
  MOD_RES (7)..(7): Any amino acid comprising an acidic side chain
  MOD_RES (8)..(8): Any amino acid comprising an acidic side chain or an amino acid comprising a small hydrophobic side chain
  MOD_RES (9)..(9): Any amino acid comprising a small hydrophobic side chain
  MOD_RES (10)..(10): Any amino acid comprising a large hydrophobic side chain or an amino acid comprising a small hydrophobic side chain
  MOD_RES (11)..(11): Any amino acid comprising a large hydrophobic side chain
  MOD_RES (12)..(12): Any amino acid comprising a polar/neutral side chain
  MOD_RES (14)..(14): Any amino acid comprising a small hydrophobic side chain or an amino acid comprising a large hydrophobic side chain
  MOD_RES (15)..(15): Any amino acid comprising a large hydrophobic side chain
  MOD_RES (16)..(16): Any amino acid comprising a large hydrophobic side chain
XXXXXXXXXXXXCXXX

SEQ ID NO: 390 - protein, 14 aa, Artificial Sequence
  Description of Artificial Sequence: Synthetic peptide
  MOD_RES (1)..(1): Any amino acid comprising a small hydrophobic side chain or cysteine
  MOD_RES (2)..(2): Any amino acid comprising a large hydrophobic side chain
  MOD_RES (3)..(3): Any amino acid comprising a basic side chain or cysteine
  MOD_RES (4)..(4): Any amino acid comprising a large hydrophobic side chain or an amino acid comprising small hydrophobic side chain
  MOD_RES (5)..(5): Any amino acid comprising a large hydrophobic side chain or an amino acid comprising an acidic side chain
  MOD_RES (6)..(6): Any amino acid comprising an acidic side chain
  MOD_RES (7)..(7): Any amino acid comprising an acidic side chain or an amino acid comprising a small hydrophobic side chain
  MOD_RES (8)..(8): Any amino acid comprising a small hydrophobic side chain
  MOD_RES (9)..(9): Any amino acid comprising a large hydrophobic side chain or an amino acid comprising a small hydrophobic side chain
  MOD_RES (10)..(10): Any amino acid comprising a large hydrophobic side chain
  MOD_RES (11)..(11): Any amino acid comprising a polar/neutral side chain
  MOD_RES (13)..(13): Any amino acid comprising a small hydrophobic side chain or an amino acid comprising a large hydrophobic side chain
  MOD_RES (14)..(14): Any amino acid comprising a large hydrophobic side chain
XXXXXXXXXXXCXX

SEQ ID NO: 391 - protein, 12 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a basic side chain or cysteine
  MOD_RES (3)..(3): Any amino acid comprising a large hydrophobic side chain or an amino acid comprising small hydrophobic side chain
  MOD_RES (4)..(4): Any amino acid comprising a large hydrophobic side chain or an amino acid comprising an acidic side chain
  MOD_RES (5)..(5): Any amino acid comprising an acidic side chain
  MOD_RES (6)..(6): Any amino acid comprising an acidic side chain or an amino acid comprising a small hydrophobic side chain
  MOD_RES (7)..(7): Any amino acid comprising a small hydrophobic side chain
  MOD_RES (8)..(8): Any amino acid comprising a large hydrophobic side chain or an amino acid comprising a small hydrophobic side chain
  MOD_RES (9)..(9): Any amino acid comprising a large hydrophobic side chain
  MOD_RES (10)..(10): Any amino acid comprising a polar/neutral side chain
  MOD_RES (12)..(12): Any amino acid comprising a small hydrophobic side chain or an amino acid comprising a large hydrophobic side chain
XXXXXXXXXXCX

SEQ ID NO: 392 - protein, 10 aa, Artificial Sequence
  Description of Artificial Sequence: Synthetic peptide
  MOD_RES (1)..(1): Any amino acid comprising a basic side chain or cysteine
  MOD_RES (2)..(2): Any amino acid comprising a large hydrophobic side chain or an amino acid comprising small hydrophobic side chain
  MOD_RES (3)..(3): Any amino acid comprising a large hydrophobic side chain or an amino acid comprising an acidic side chain
  MOD_RES (4)..(4): Any amino acid comprising an acidic side chain
  MOD_RES (5)..(5): Any amino acid comprising an acidic side chain or an amino acid comprising a small hydrophobic side chain
  MOD_RES (6)..(6): Any amino acid comprising a small hydrophobic side chain
  MOD_RES (7)..(7): Any amino acid comprising a large hydrophobic side chain or an amino acid comprising a small hydrophobic side chain
  MOD_RES (8)..(8): Any amino acid comprising a large hydrophobic side chain
  MOD_RES (9)..(9): Any amino acid comprising a polar/neutral side chain
XXXXXXXXXC

SEQ ID NO: 393 - protein, 20 aa, Artificial Sequence
  Description of Artificial Sequence: Synthetic peptide
HCLHWNIETLMSCVYGNFEE

SEQ ID NO: 394 - protein, 14 aa, Artificial Sequence
  Description of Artificial Sequence: Synthetic peptide
HCKHWDLESLLLCV

SEQ ID NO: 395 - protein, 22 aa, Artificial Sequence
  Description of Artificial Sequence: Synthetic peptide
HLGVPWCTLDPGSIQCAWLAKH

SEQ ID NO: 396 - protein, 22 aa, Artificial Sequence
  Description of Artificial Sequence: Synthetic peptide
IRSCLWQPGALHCTWWAEEEPV

SEQ ID NO: 397 - protein, 16 aa, Artificial Sequence
  Description of Artificial Sequence: Synthetic peptide
IPWCLLDPGGLQCVWL

SEQ ID NO: 398 - protein, 22 aa, Artificial Sequence
  Description of Artificial Sequence: Synthetic peptide
KAGSWFIPWCTLDPGSLQCAFL

SEQ ID NO: 399 - protein, 22 aa, Artificial Sequence
  Description of Artificial Sequence: Synthetic peptide
NPFRSVVPWCALDPGSLQCAWL

SEQ ID NO: 400 - protein, 14 aa, Artificial Sequence
  Description of Artificial Sequence: Synthetic peptide
QCIHWDIETLLSCV

SEQ ID NO: 401 - protein, 20 aa, Artificial Sequence
  Description of Artificial Sequence: Synthetic peptide
QCIHWDLESLLNCLRELKEP

SEQ ID NO: 402 - protein, 20 aa, Artificial Sequence
  Description of Artificial Sequence: Synthetic peptide
QCVHWDLDTLFGCIREQLEL

SEQ ID NO: 403 - protein, 22 aa, Artificial Sequence
  Description of Artificial Sequence: Synthetic peptide
RHFDDIIPWCTLDPGSLQCAYL

SEQ ID NO: 404 - protein, 20 aa, Artificial Sequence
  Description of Artificial Sequence: Synthetic peptide
SAKVLKQCLHWDLESLLSCL

SEQ ID NO: 405 - protein, 22 aa, Artificial Sequence
  Description of Artificial Sequence: Synthetic peptide
SLTVPWCTLDPGSMQCAWLQNR

SEQ ID NO: 406 - protein, 16 aa, Artificial Sequence
  Description of Artificial Sequence: Synthetic peptide
VPWCMLDPGSMQCAWL

SEQ ID NO: 407 - protein, 22 aa, Artificial Sequence
  Description of Artificial Sequence: Synthetic peptide
VHRIPWCTLDPGGLQCAWLRQM

SEQ ID NO: 408 - protein, 22 aa, Artificial Sequence
  Description of Artificial Sequence: Synthetic peptide
WVTIPWCILDPGSLQCEWQTKV

SEQ ID NO: 409 - protein, 22 aa, Artificial Sequence
  Description of Artificial Sequence: Synthetic peptide
GWGIPWCTLDPGSLQCAWLGKH

SEQ ID NO: 410 - protein, 22 aa, Artificial Sequence
  Description of Artificial Sequence: Synthetic peptide
YRSGHGIPWCMLDPGGLQCSWL

SEQ ID NO: 411 - protein, 286 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSIEGRGGQCIHWDIETLLSCVGGGGSGGVVCQDWEGVELCWQGG

SEQ ID NO: 412 - protein, 288 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSIEGRGGVPWCTLDPGSLQCAWFGGGGSGGVVCQDWEGVELCWQGG

SEQ ID NO: 413 - protein, 288 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSIEGRGGRYECADLPGGLHCEFRGGGGSGGVVCQDWEGVELCWQGG

SEQ ID NO: 414 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGRHFDDIIPWCTLDPGSLQCAYLGGGGSGGVVCQDWEGVELCWQGG

SEQ ID NO: 415 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGHLGVPWCTLDPGSIQCAWLAKHGGGGSGGVVCQDWEGVELCWQGG

SEQ ID NO: 416 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGVVCQDWEGVELCWQGGGGSGGRHFDDIIPWCTLDPGSLQCAYLGG

SEQ ID NO: 417 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGVVCQDWEGVELCWQGGGGSGGHLGVPWCTLDPGSIQCAWLAKHGG

SEQ ID NO: 418 - protein, 300 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGVHRIPWCTLDPGGLQCAWLRQMGGGGSGGVVCQDWEGVELCWQGG

SEQ ID NO: 419 - protein, 292 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGHCKHWDLESLLLCVGGGGSGGVVCQDWEGVELCWQGG

SEQ ID NO: 420 - protein, 35 aa, Artificial Sequence
  Description of Artificial Sequence: Synthetic polypeptide
QCIHWDIETLLSCVGGGGSGGVVCQDWEGVELCWQ

SEQ ID NO: 421 - protein, 37 aa, Artificial Sequence
  Description of Artificial Sequence: Synthetic polypeptide
VPWCTLDPGSLQCAWFGGGGSGGVVCQDWEGVELCWQ

SEQ ID NO: 422 - protein, 37 aa, Artificial Sequence
  Description of Artificial Sequence: Synthetic polypeptide
RYECADLPGGLHCEFRGGGGSGGVVCQDWEGVELCWQ

SEQ ID NO: 423 - protein, 43 aa, Artificial Sequence
  Description of Artificial Sequence: Synthetic polypeptide
RHFDDIIPWCTLDPGSLQCAYLGGGGSGGVVCQDWEGVELCWQ

SEQ ID NO: 424 - protein, 43 aa, Artificial Sequence
  Description of Artificial Sequence: Synthetic polypeptide
HLGVPWCTLDPGSIQCAWLAKHGGGGSGGVVCQDWEGVELCWQ

SEQ ID NO: 425 - protein, 43 aa, Artificial Sequence
  Description of Artificial Sequence: Synthetic polypeptide
VVCQDWEGVELCWQGGGGSGGRHFDDIIPWCTLDPGSLQCAYL

SEQ ID NO: 426 - protein, 43 aa, Artificial Sequence
  Description of Artificial Sequence: Synthetic polypeptide
VVCQDWEGVELCWQGGGGSGGHLGVPWCTLDPGSIQCAWLAKH

SEQ ID NO: 427 - protein, 43 aa, Artificial Sequence
  Description of Artificial Sequence: Synthetic polypeptide
VHRIPWCTLDPGGLQCAWLRQMGGGGSGGVVCQDWEGVELCWQ

SEQ ID NO: 428 - protein, 35 aa, Artificial Sequence
  Description of Artificial Sequence: Synthetic polypeptide
HCKHWDLESLLLCVGGGGSGGVVCQDWEGVELCWQ

SEQ ID NO: 429 - protein, 14 aa, Artificial Sequence
  Description of Artificial Sequence: Synthetic peptide
VVCQDWEGVELCWQ

SEQ ID NO: 430-431 - skipped (2 entries)

SEQ ID NO: 432 - protein, 16 aa, Artificial Sequence
  Description of Artificial Sequence: Synthetic peptide
WHPCWIAQLGELCDLE

SEQ ID NO: 433 - protein, 18 aa, Artificial Sequence
  Description of Artificial Sequence: Synthetic peptide
GWHPCWIAQLGELCDLEG

SEQ ID NO: 434 - protein, 20 aa, Artificial Sequence
  Description of Artificial Sequence: Synthetic peptide
GGWHPCWIAQLGELCDLEGG

SEQ ID NO: 435 - protein, 22 aa, Artificial Sequence
  Description of Artificial Sequence: Synthetic peptide
GGGWHPCWIAQLGELCDLEGGG

SEQ ID NO: 436 - protein, 10 aa, Artificial Sequence
  Description of Artificial Sequence: Synthetic peptide
  SITE (1)..(10): This sequence may encompass 1-10 residues
  See specification as filed for detailed description of substitutions and preferred embodiments
GGGGGGGGGG

SEQ ID NO: 437-457 - skipped (21 entries)

SEQ ID NO: 458 - protein, 18 aa, Artificial Sequence
  Description of Artificial Sequence: Synthetic peptide
GGVPWCTLDPGSLQCAWF

SEQ ID NO: 459-461 - skipped (3 entries)

SEQ ID NO: 462 - protein, 25 aa, Artificial Sequence
  Description of Artificial Sequence: Synthetic peptide
GGHLGVPWCTLDPGSIQCAWLAKHG

SEQ ID NO: 463 - protein, 26 aa, Artificial Sequence
  Description of Artificial Sequence: Synthetic peptide
GGHLGVPWCTLDPGSIQCAWLAKHGG

SEQ ID NO: 464 - skipped

SEQ ID NO: 465 - protein, 18 aa, Artificial Sequence
  Description of Artificial Sequence: Synthetic peptide
GGVVCQDWEGVELCWQGG

SEQ ID NO: 466-513 - skipped (48 entries)

SEQ ID NO: 514 - protein, 19 aa, Artificial Sequence
  Description of Artificial Sequence: Synthetic peptide
VHRIPWCTLDPGGLQCAWL

SEQ ID NO: 515-519 - skipped (5 entries)

SEQ ID NO: 520 - protein, 19 aa, Artificial Sequence
  Description of Artificial Sequence: Synthetic peptide
IPWCTLDPGGLQCAWLRQM

SEQ ID NO: 521 - protein, 19 aa, Artificial Sequence
  Description of Artificial Sequence: Synthetic peptide
IPWCTLDPGGLQCAALRQM

SEQ ID NO: 522 - protein, 19 aa, Artificial Sequence
  Description of Artificial Sequence: Synthetic peptide
IPWCTLDPGGLQCAFLRQM

SEQ ID NO: 523 - protein, 19 aa, Artificial Sequence
  Description of Artificial Sequence: Synthetic peptide
IPWCTLDPGGLQCAYLRQM

SEQ ID NO: 524 - protein, 19 aa, Artificial Sequence
  Description of Artificial Sequence: Synthetic peptide
IPWCTLDPGGLQCAHLRQM

SEQ ID NO: 525 - protein, 19 aa, Artificial Sequence
  Description of Artificial Sequence: Synthetic peptide
IPWCTLDPGGLQCAWARQM

SEQ ID NO: 526 - protein, 19 aa, Artificial Sequence
  Description of Artificial Sequence: Synthetic peptide
IPWCTLDPGGLQCAWIRQM

SEQ ID NO: 527 - protein, 19 aa, Artificial Sequence
  Description of Artificial Sequence: Synthetic peptide
IPWCTLDPGGLQCAWVRQM

SEQ ID NO: 528 - protein, 19 aa, Artificial Sequence
  Description of Artificial Sequence: Synthetic peptide
IPWCTLDPGGLQCAWLAQM

SEQ ID NO: 529 - protein, 19 aa, Artificial Sequence
  Description of Artificial Sequence: Synthetic peptide
IPWCTLDPGGLQCAWLKQM

SEQ ID NO: 530 - protein, 19 aa, Artificial Sequence
  Description of Artificial Sequence: Synthetic peptide
IPWCTLDPGGLQCAWLHQM

SEQ ID NO: 531 - protein, 19 aa, Artificial Sequence
  Description of Artificial Sequence: Synthetic peptide
IPWCTLDPGGLQCAWLRAM

SEQ ID NO: 532 - protein, 19 aa, Artificial Sequence
  Description of Artificial Sequence: Synthetic peptide
IPWCTLDPGGLQCAWLRQA

SEQ ID NO: 533 - protein, 19 aa, Artificial Sequence
  Description of Artificial Sequence: Synthetic peptide
IPWCTLDPGGLQCAWLRAA

SEQ ID NO: 534 - protein, 19 aa, Artificial Sequence
  Description of Artificial Sequence: Synthetic peptide
IPWCTLDPGGLQCAWLAAA

SEQ ID NO: 535 - protein, 18 aa, Artificial Sequence
  Description of Artificial Sequence: Synthetic peptide
IPWCTLDPGGLQCAWLRQ

SEQ ID NO: 536 - protein, 17 aa, Artificial Sequence
  Description of Artificial Sequence: Synthetic peptide
IPWCTLDPGGLQCAWLR

SEQ ID NO: 537 - protein, 16 aa, Artificial Sequence
  Description of Artificial Sequence: Synthetic peptide
IPWCTLDPGGLQCAWL

SEQ ID NO: 538 - protein, 15 aa, Artificial Sequence
  Description of Artificial Sequence: Synthetic peptide
IPWCTLDPGGLQCAW

SEQ ID NO: 539 - protein, 21 aa, Artificial Sequence
  Description of Artificial Sequence: Synthetic peptide
IPWCTLDPGGLQCAWLRQMGG

SEQ ID NO: 540 - protein, 20 aa, Artificial Sequence
  Description of Artificial Sequence: Synthetic peptide
IPWCTLDPGGLQCAWLRQGG

SEQ ID NO: 541 - protein, 19 aa, Artificial Sequence
  Description of Artificial Sequence: Synthetic peptide
IPWCTLDPGGLQCAWLRGG

SEQ ID NO: 542 - protein, 18 aa, Artificial Sequence
  Description of Artificial Sequence: Synthetic peptide
IPWCTLDPGGLQCAWLGG

SEQ ID NO: 543 - protein, 17 aa, Artificial Sequence
  Description of Artificial Sequence: Synthetic peptide
IPWCTLDPGGLQCAWGG

SEQ ID NO: 544 - protein, 21 aa, Artificial Sequence
  Description of Artificial Sequence: Synthetic peptide
GGIPWCTLDPGGLQCAWLRQM

SEQ ID NO: 545 - protein, 20 aa, Artificial Sequence
  Description of Artificial Sequence: Synthetic peptide
GGIPWCTLDPGGLQCAWLRQ

SEQ ID NO: 546 - protein, 19 aa, Artificial Sequence
  Description of Artificial Sequence: Synthetic peptide
GGIPWCTLDPGGLQCAWLR

SEQ ID NO: 547 - protein, 18 aa, Artificial Sequence
  Description of Artificial Sequence: Synthetic peptide
GGIPWCTLDPGGLQCAWL

SEQ ID NO: 548 - protein, 17 aa, Artificial Sequence
  Description of Artificial Sequence: Synthetic peptide
GGIPWCTLDPGGLQCAW

SEQ ID NO: 549 - protein, 23 aa, Artificial Sequence
  Description of Artificial Sequence: Synthetic peptide
GGIPWCTLDPGGLQCAWLRQMGG

SEQ ID NO: 550 - protein, 22 aa, Artificial Sequence
  Description of Artificial Sequence: Synthetic peptide
GGIPWCTLDPGGLQCAWLRQGG

SEQ ID NO: 551 - protein, 21 aa, Artificial Sequence
  Description of Artificial Sequence: Synthetic peptide
GGIPWCTLDPGGLQCAWLRGG

SEQ ID NO: 552 - protein, 20 aa, Artificial Sequence
  Description of Artificial Sequence: Synthetic peptide
GGIPWCTLDPGGLQCAWLGG

SEQ ID NO: 553 - protein, 19 aa, Artificial Sequence
  Description of Artificial Sequence: Synthetic peptide
GGIPWCTLDPGGLQCAWGG

SEQ ID NO: 554 - protein, 24 aa, Artificial Sequence
  Description of Artificial Sequence: Synthetic peptide
VHRIPWCTLDPGGLQCAWLRQMGG

SEQ ID NO: 555 - protein, 24 aa, Artificial Sequence
  Description of Artificial Sequence: Synthetic peptide
GGVHRIPWCTLDPGGLQCAWLRQM

SEQ ID NO: 556 - protein, 26 aa, Artificial Sequence
  Description of Artificial Sequence: Synthetic peptide
GGVHRIPWCTLDPGGLQCAWLRQMGG

SEQ ID NO: 557 - protein, 21 aa, Artificial Sequence
  Description of Artificial Sequence: Synthetic peptide
VHRIPWCTLDPGGLQCAWLRQ

SEQ ID NO: 558 - protein, 20 aa, Artificial Sequence
  Description of Artificial Sequence: Synthetic peptide
VHRIPWCTLDPGGLQCAWLR

SEQ ID NO: 559 - protein, 21 aa, Artificial Sequence
  Description of Artificial Sequence: Synthetic peptide
VHRIPWCTLDPGGLQCAWLRM

SEQ ID NO: 560 - protein, 23 aa, Artificial Sequence
  Description of Artificial Sequence: Synthetic peptide
GGVHRIPWCTLDPGGLQCAWLRQ

SEQ ID NO: 561 - protein, 22 aa, Artificial Sequence
  Description of Artificial Sequence: Synthetic peptide
GGVHRIPWCTLDPGGLQCAWLR

SEQ ID NO: 562 - protein, 23 aa, Artificial Sequence
  Description of Artificial Sequence: Synthetic peptide
GGVHRIPWCTLDPGGLQCAWLRM

SEQ ID NO: 563 - protein, 22 aa, Artificial Sequence
  Description of Artificial Sequence: Synthetic peptide
VHRIPWCTLDPGGLQCAWARQM

SEQ ID NO: 564 - protein, 24 aa, Artificial Sequence
  Description of Artificial Sequence: Synthetic peptide
VHRIPWCTLDPGGLQCAWARQMGG

SEQ ID NO: 565 - protein, 24 aa, Artificial Sequence
  Description of Artificial Sequence: Synthetic peptide
GGVHRIPWCTLDPGGLQCAWARQM

SEQ ID NO: 566 - protein, 26 aa, Artificial Sequence
  Description of Artificial Sequence: Synthetic peptide
GGVHRIPWCTLDPGGLQCAWARQMGG

SEQ ID NO: 567 - protein, 22 aa, Artificial Sequence
  Description of Artificial Sequence: Synthetic peptide
VHRIPWCTLDPGGLQCAWVRQM

SEQ ID NO: 568 - protein, 24 aa, Artificial Sequence
  Description of Artificial Sequence: Synthetic peptide
VHRIPWCTLDPGGLQCAWVRQMGG

SEQ ID NO: 569 - protein, 24 aa, Artificial Sequence
  Description of Artificial Sequence: Synthetic peptide
GGVHRIPWCTLDPGGLQCAWVRQM

SEQ ID NO: 570 - protein, 26 aa, Artificial Sequence
  Description of Artificial Sequence: Synthetic peptide
GGVHRIPWCTLDPGGLQCAWVRQMGG

SEQ ID NO: 571 - protein, 22 aa, Artificial Sequence
  Description of Artificial Sequence: Synthetic peptide
VHRIPWCTLDPGGLQCAWIRQM

SEQ ID NO: 572 - protein, 24 aa, Artificial Sequence
  Description of Artificial Sequence: Synthetic peptide
VHRIPWCTLDPGGLQCAWIRQMGG

SEQ ID NO: 573 - protein, 24 aa, Artificial Sequence
  Description of Artificial Sequence: Synthetic peptide
GGVHRIPWCTLDPGGLQCAWIRQM

SEQ ID NO: 574 - protein, 26 aa, Artificial Sequence
  Description of Artificial Sequence: Synthetic peptide
GGVHRIPWCTLDPGGLQCAWIRQMGG

SEQ ID NO: 575 - protein, 20 aa, Artificial Sequence
  Description of Artificial Sequence: Synthetic peptide
IEGRGGQCIHWDIETLLSCV

SEQ ID NO: 576 - protein, 22 aa, Artificial Sequence
  Description of Artificial Sequence: Synthetic peptide
IEGRGGVPWCTLDPGSLQCAWF

SEQ ID NO: 577 - protein, 22 aa, Artificial Sequence
  Description of Artificial Sequence: Synthetic peptide
IEGRGGRYECADLPGGLHCEFR

SEQ ID NO: 578 - protein, 21 aa, Artificial Sequence
  Description of Artificial Sequence: Synthetic peptide
RSCLWQPGALHCTWWAEEEPV

SEQ ID NO: 579 - protein, 22 aa, Artificial Sequence
  Description of Artificial Sequence: Synthetic peptide
GGIEGRGGQCIHWDIETLLSCV

SEQ ID NO: 580 - protein, 24 aa, Artificial Sequence
  Description of Artificial Sequence: Synthetic peptide
GGIEGRGGVPWCTLDPGSLQCAWF

SEQ ID NO: 581 - protein, 24 aa, Artificial Sequence
  Description of Artificial Sequence: Synthetic peptide
GGIEGRGGRYECADLPGGLHCEFR

SEQ ID NO: 582 - protein, 23 aa, Artificial Sequence
  Description of Artificial Sequence: Synthetic peptide
GGRSCLWQPGALHCTWWAEEEPV

SEQ ID NO: 583 - protein, 21 aa, Artificial Sequence
  Description of Artificial Sequence: Synthetic peptide
QCVHWDLDTLFGCIREQLEGG

SEQ ID NO: 584 - protein, 22 aa, Artificial Sequence
  Description of Artificial Sequence: Synthetic peptide
QCVHWDLDTLFGCIREQLELGG

SEQ ID NO: 585 - protein, 22 aa, Artificial Sequence
  Description of Artificial Sequence: Synthetic peptide
GGQCVHWDLDTLFGCIREQLEL

SEQ ID NO: 586 - protein, 24 aa, Artificial Sequence
  Description of Artificial Sequence: Synthetic peptide
GGQCVHWDLDTLFGCIREQLELGG

SEQ ID NO: 587 - protein, 26 aa, Artificial Sequence
  Description of Artificial Sequence: Synthetic peptide
GGHLGVPWCTLDPGSIQCAWLAKHGG

SEQ ID NO: 588 - protein, 18 aa, Artificial Sequence
  Description of Artificial Sequence: Synthetic peptide
VHRIPWCTLDPGGLQCAW

SEQ ID NO: 589 - protein, 17 aa, Artificial Sequence
  Description of Artificial Sequence: Synthetic peptide
VHRIPWCTLDPGGLQCA

SEQ ID NO: 590 - protein, 16 aa, Artificial Sequence
  Description of Artificial Sequence: Synthetic peptide
VHRIPWCTLDPGGLQC

SEQ ID NO: 591 - protein, 23 aa, Artificial Sequence
  Description of Artificial Sequence: Synthetic peptide
HRIPWCTLDPGGLQCAWLRQMGG

SEQ ID NO: 592 - protein, 22 aa, Artificial Sequence
  Description of Artificial Sequence: Synthetic peptide
RIPWCTLDPGGLQCAWLRQMGG

SEQ ID NO: 593 - protein, 21 aa, Artificial Sequence
  Description of Artificial Sequence: Synthetic peptide
IPWCTLDPGGLQCAWLRQMGG

SEQ ID NO: 594 - protein, 20 aa, Artificial Sequence
  Description of Artificial Sequence: Synthetic peptide
PWCTLDPGGLQCAWLRQMGG

SEQ ID NO: 595 - protein, 19 aa, Artificial Sequence
  Description of Artificial Sequence: Synthetic peptide
WCTLDPGGLQCAWLRQMGG

SEQ ID NO: 596 - protein, 18 aa, Artificial Sequence
  Description of Artificial Sequence: Synthetic peptide
CTLDPGGLQCAWLRQMGG

SEQ ID NO: 597 - protein, 22 aa, Artificial Sequence
  Description of Artificial Sequence: Synthetic peptide
  MOD_RES (1)..(1): A, G, P, S, T or V
  MOD_RES (2)..(2): F, H, W or Y
  MOD_RES (3)..(3): A, G, H, K, P, R, S or T
  MOD_RES (13)..(13): A, G, P, S or T
  MOD_RES (20)..(20): A, G, H, K, P, R, S or T
  MOD_RES (21)..(21): Any amino acid or absent
  MOD_RES (22)..(22): Any amino acid or absent
XXXIPWCTLDPGXLQCAWLXXX

SEQ ID NO: 598 - protein, 21 aa, Artificial Sequence
  Description of Artificial Sequence: Synthetic peptide
  MOD_RES (1)..(1): F, H, W or Y
  MOD_RES (2)..(2): A, G, H, K, P, R, S or T
  MOD_RES (12)..(12): A, G, P, S or T
  MOD_RES (19)..(19): A, G, H, K, P, R, S or T
  MOD_RES (20)..(20): Any amino acid or absent
  MOD_RES (21)..(21): Any amino acid or absent
XXIPWCTLDPGXLQCAWLXXX

SEQ ID NO: 599 - protein, 20 aa, Artificial Sequence
  Description of Artificial Sequence: Synthetic peptide
  MOD_RES (1)..(1): A, G, H, K, P, R, S or T
  MOD_RES (11)..(11): A, G, P, S or T
  MOD_RES (18)..(18): A, G, H, K, P, R, S or T
  MOD_RES (19)..(19): Any amino acid or absent
  MOD_RES (20)..(20): Any amino acid or absent
XIPWCTLDPGXLQCAWLXXX

SEQ ID NO: 600 - protein, 19 aa, Artificial Sequence
  Description of Artificial Sequence: Synthetic peptide
  MOD_RES (10)..(10): A, G, P, S or T
  MOD_RES (17)..(17): A, G, H, K, P, R, S or T
  MOD_RES (18)..(18): Any amino acid or absent
  MOD_RES (19)..(19): Any amino acid or absent
IPWCTLDPGXLQCAWLXXX

SEQ ID NO: 601 - protein, 21 aa, Artificial Sequence
  Description of Artificial Sequence: Synthetic peptide
  MOD_RES (1)..(1): A, G, P, S, T or V
  MOD_RES (2)..(2): F, H, W or Y
  MOD_RES (3)..(3): A, G, H, K, P, R, S or T
  MOD_RES (13)..(13): A, G, P, S or T
  MOD_RES (20)..(20): A, G, H, K, P, R, S or T
  MOD_RES (21)..(21): Any amino acid or absent
XXXIPWCTLDPGXLQCAWLXX

SEQ ID NO: 602 - protein, 20 aa, Artificial Sequence
  Description of Artificial Sequence: Synthetic peptide
  MOD_RES (1)..(1): A, G, P, S, T or V
  MOD_RES (2)..(2): F, H, W or Y
  MOD_RES (3)..(3): A, G, H, K, P, R, S or T
  MOD_RES (13)..(13): A, G, P, S or T
  MOD_RES (20)..(20): A, G, H, K, P, R, S or T
XXXIPWCTLDPGXLQCAWLX

SEQ ID NO: 603 - protein, 19 aa, Artificial Sequence
  Description of Artificial Sequence: Synthetic peptide
  MOD_RES (1)..(1): A, G, P, S, T or V
  MOD_RES (2)..(2): F, H, W or Y
  MOD_RES (3)..(3): A, G, H, K, P, R, S or T
  MOD_RES (13)..(13): A, G, P, S or T
XXXIPWCTLDPGXLQCAWL

SEQ ID NO: 604 - protein, 18 aa, Artificial Sequence
  Description of Artificial Sequence: Synthetic peptide
  MOD_RES (1)..(1): A, G, P, S, T or V
  MOD_RES (2)..(2): F, H, W or Y
  MOD_RES (3)..(3): A, G, H, K, P, R, S or T
  MOD_RES (12)..(12): A, G, P, S or T
XXXIPWCTLDPXLQCAWL

SEQ ID NO: 605 - protein, 18 aa, Artificial Sequence
  Description of Artificial Sequence: Synthetic peptide
IPWCTLDPGGLQCAWLRG

SEQ ID NO: 606 - protein, 19 aa, Artificial Sequence
  Description of Artificial Sequence: Synthetic peptide
IPWCTLDPGGLQCAWLRQG

SEQ ID NO: 607 - protein, 19 aa, Artificial Sequence
  Description of Artificial Sequence: Synthetic peptide
IPWCTLDPGGLQCAWLRGG

SEQ ID NO: 608 - protein, 17 aa, Artificial Sequence
  Description of Artificial Sequence: Synthetic peptide
IPWCTLDPGGLQCAWLG

SEQ ID NO: 609 - protein, 18 aa, Artificial Sequence
  Description of Artificial Sequence: Synthetic peptide
IPWCTLDPGGLQCAWLGK

SEQ ID NO: 610 - protein, 19 aa, Artificial Sequence
  Description of Artificial Sequence: Synthetic peptide
IPWCTLDPGGLQCAWLGKH

SEQ ID NO: 611 - protein, 19 aa, Artificial Sequence
  Description of Artificial Sequence: Synthetic peptide
VHRIPWCTLDPGGLQCAWL

SEQ ID NO: 612 - protein, 20 aa, Artificial Sequence
  Description of Artificial Sequence: Synthetic peptide
VHRIPWCTLDPGGLQCAWLR

SEQ ID NO: 613 - protein, 21 aa, Artificial Sequence
  Description of Artificial Sequence: Synthetic peptide
VHRIPWCTLDPGGLQCAWLRQ

SEQ ID NO: 614 - protein, 21 aa, Artificial Sequence
  Description of Artificial Sequence: Synthetic peptide
VHRIPWCTLDPGGLQCAWLRG

SEQ ID NO: 615 - protein, 22 aa, Artificial Sequence
  Description of Artificial Sequence: Synthetic peptide
VHRIPWCTLDPGGLQCAWLRQG

SEQ ID NO: 616 - protein, 22 aa, Artificial Sequence
  Description of Artificial Sequence: Synthetic peptide
VHRIPWCTLDPGGLQCAWLRGG

SEQ ID NO: 617 - protein, 20 aa, Artificial Sequence
  Description of Artificial Sequence: Synthetic peptide
VHRIPWCTLDPGGLQCAWLG

SEQ ID NO: 618 - protein, 21 aa, Artificial Sequence
  Description of Artificial Sequence: Synthetic peptide
VHRIPWCTLDPGGLQCAWLGK

SEQ ID NO: 619 - protein, 22 aa, Artificial Sequence
  Description of Artificial Sequence: Synthetic peptide
VHRIPWCTLDPGGLQCAWLGKH

SEQ ID NO: 620 - protein, 19 aa, Artificial Sequence
  Description of Artificial Sequence: Synthetic peptide
GWGIPWCTLDPGGLQCAWL

SEQ ID NO: 621 - protein, 20 aa, Artificial Sequence
  Description of Artificial Sequence: Synthetic peptide
GWGIPWCTLDPGGLQCAWLR

SEQ ID NO: 622 - protein, 21 aa, Artificial Sequence
  Description of Artificial Sequence: Synthetic peptide
GWGIPWCTLDPGGLQCAWLRQ

SEQ ID NO: 623 - protein, 21 aa, Artificial Sequence
  Description of Artificial Sequence: Synthetic peptide
GWGIPWCTLDPGGLQCAWLRG

SEQ ID NO: 624 - protein, 22 aa, Artificial Sequence
  Description of Artificial Sequence: Synthetic peptide
GWGIPWCTLDPGGLQCAWLRQG

SEQ ID NO: 625 - protein, 22 aa, Artificial Sequence
  Description of Artificial Sequence: Synthetic peptide
GWGIPWCTLDPGGLQCAWLRGG

SEQ ID NO: 626 - protein, 20 aa, Artificial Sequence
  Description of Artificial Sequence: Synthetic peptide
GWGIPWCTLDPGGLQCAWLG

SEQ ID NO: 627 - protein, 21 aa, Artificial Sequence
  Description of Artificial Sequence: Synthetic peptide
GWGIPWCTLDPGGLQCAWLGK

SEQ ID NO: 628 - protein, 22 aa, Artificial Sequence
  Description of Artificial Sequence: Synthetic peptide
GWGIPWCTLDPGGLQCAWLGKH

SEQ ID NO: 629 - protein, 16 aa, Artificial Sequence
  Description of Artificial Sequence: Synthetic peptide
IPWCTLDPGSLQCAWL

SEQ ID NO: 630 - protein, 17 aa, Artificial Sequence
  Description of Artificial Sequence: Synthetic peptide
IPWCTLDPGSLQCAWLR

SEQ ID NO: 631 - protein, 18 aa, Artificial Sequence
  Description of Artificial Sequence: Synthetic peptide
IPWCTLDPGSLQCAWLRQ

SEQ ID NO: 632 - protein, 18 aa, Artificial Sequence
  Description of Artificial Sequence: Synthetic peptide
IPWCTLDPGSLQCAWLRG

SEQ ID NO: 633 - protein, 19 aa, Artificial Sequence
  Description of Artificial Sequence: Synthetic peptide
IPWCTLDPGSLQCAWLRQG

SEQ ID NO: 634 - protein, 19 aa, Artificial Sequence
  Description of Artificial Sequence: Synthetic peptide
IPWCTLDPGSLQCAWLRGG

SEQ ID NO: 635 - protein, 17 aa, Artificial Sequence
  Description of Artificial Sequence: Synthetic peptide
IPWCTLDPGSLQCAWLG

SEQ ID NO: 636 - protein, 18 aa, Artificial Sequence
  Description of Artificial Sequence: Synthetic peptide
IPWCTLDPGSLQCAWLGK

SEQ ID NO: 637 - protein, 19 aa, Artificial Sequence
  Description of Artificial Sequence: Synthetic peptide
IPWCTLDPGSLQCAWLGKH

SEQ ID NO: 638 - protein, 19 aa, Artificial Sequence
  Description of Artificial Sequence: Synthetic peptide
VHRIPWCTLDPGSLQCAWL

SEQ ID NO: 639 - protein, 20 aa, Artificial Sequence
  Description of Artificial Sequence: Synthetic peptide
VHRIPWCTLDPGSLQCAWLR

SEQ ID NO: 640 - protein, 21 aa, Artificial Sequence
  Description of Artificial Sequence: Synthetic peptide
VHRIPWCTLDPGSLQCAWLRQ

SEQ ID NO: 641 - protein, 21 aa, Artificial Sequence
  Description of Artificial Sequence: Synthetic peptide
VHRIPWCTLDPGSLQCAWLRG

SEQ ID NO: 642 - protein, 22 aa, Artificial Sequence
  Description of Artificial Sequence: Synthetic peptide
VHRIPWCTLDPGSLQCAWLRQG

SEQ ID NO: 643 - protein, 22 aa, Artificial Sequence
  Description of Artificial Sequence: Synthetic peptide
VHRIPWCTLDPGSLQCAWLRGG

SEQ ID NO: 644 - protein, 20 aa, Artificial Sequence
  Description of Artificial Sequence: Synthetic peptide
VHRIPWCTLDPGSLQCAWLG

SEQ ID NO: 645 - protein, 21 aa, Artificial Sequence
  Description of Artificial Sequence: Synthetic peptide
VHRIPWCTLDPGSLQCAWLGK

SEQ ID NO: 646 - protein, 22 aa, Artificial Sequence
  Description of Artificial Sequence: Synthetic peptide
VHRIPWCTLDPGSLQCAWLGKH

SEQ ID NO: 647 - protein, 19 aa, Artificial Sequence
  Description of Artificial Sequence: Synthetic peptide
GWGIPWCTLDPGSLQCAWL

SEQ ID NO: 648 - protein, 20 aa, Artificial Sequence
  Description of Artificial Sequence: Synthetic peptide
GWGIPWCTLDPGSLQCAWLR

SEQ ID NO: 649 - protein, 21 aa, Artificial Sequence
  Description of Artificial Sequence: Synthetic peptide
GWGIPWCTLDPGSLQCAWLRQ

SEQ ID NO: 650 - protein, 21 aa, Artificial Sequence
  Description of Artificial Sequence: Synthetic peptide
GWGIPWCTLDPGSLQCAWLRG

SEQ ID NO: 651 - protein, 22 aa, Artificial Sequence
  Description of Artificial Sequence: Synthetic peptide
GWGIPWCTLDPGSLQCAWLRQG

SEQ ID NO: 652 - protein, 22 aa, Artificial Sequence
  Description of Artificial Sequence: Synthetic peptide
GWGIPWCTLDPGSLQCAWLRGG

SEQ ID NO: 653 - protein, 20 aa, Artificial Sequence
  Description of Artificial Sequence: Synthetic peptide
GWGIPWCTLDPGSLQCAWLG

SEQ ID NO: 654 - protein, 21 aa, Artificial Sequence
  Description of Artificial Sequence: Synthetic peptide
GWGIPWCTLDPGSLQCAWLGK

SEQ ID NO: 655 - protein, 22 aa, Artificial Sequence
  Description of Artificial Sequence: Synthetic peptide
GWGIPWCTLDPGSLQCAWLGKH

SEQ ID NO: 656-1099 - skipped (444 entries)

SEQ ID NO: 1100 - protein, 20 aa, Artificial Sequence
  Description of Artificial Sequence: Synthetic peptide
MGFYPCWTAQLGELCDLSVD

SEQ ID NO: 1101 - protein, 19 aa, Artificial Sequence
  Description of Artificial Sequence: Synthetic peptide
GFYPCWTAQLGELCDLSVD

SEQ ID NO: 1102 - protein, 18 aa, Artificial Sequence
  Description of Artificial Sequence: Synthetic peptide
FYPCWTAQLGELCDLSVD

SEQ ID NO: 1103 - protein, 17 aa, Artificial Sequence
  Description of Artificial Sequence: Synthetic peptide
YPCWTAQLGELCDLSVD

SEQ ID NO: 1104 - protein, 19 aa, Artificial Sequence
  Description of Artificial Sequence: Synthetic peptide
MGFYPCWTAQLGELCDLSV

SEQ ID NO: 1105 - protein, 18 aa, Artificial Sequence
  Description of Artificial Sequence: Synthetic peptide
MGFYPCWTAQLGELCDLS

SEQ ID NO: 1106 - protein, 17 aa, Artificial Sequence
  Description of Artificial Sequence: Synthetic peptide
MGFYPCWTAQLGELCDL

SEQ ID NO: 1107 - protein, 18 aa, Artificial Sequence
  Description of Artificial Sequence: Synthetic peptide
GFYPCWTAQLGELCDLSV

SEQ ID NO: 1108 - protein, 15 aa, Artificial Sequence
  Description of Artificial Sequence: Synthetic peptide
FYPCWTAQLGELCDL

SEQ ID NO: 1109 - skipped

SEQ ID NO: 1110 - protein, 14 aa, Artificial Sequence
  Description of Artificial Sequence: Synthetic peptide
KYCGFAQLGELCVL

SEQ ID NO: 1111 - protein, 15 aa, Artificial Sequence
  Description of Artificial Sequence: Synthetic peptide
GKYCGFAQLGELCVL

SEQ ID NO: 1112 - protein, 16 aa, Artificial Sequence
  Description of Artificial Sequence: Synthetic peptide
GGKYCGFAQLGELCVL

SEQ ID NO: 1113 - protein, 17 aa, Artificial Sequence
  Description of Artificial Sequence: Synthetic peptide
GGGKYCGFAQLGELCVL

SEQ ID NO: 1114 - protein, 15 aa, Artificial Sequence
  Description of Artificial Sequence: Synthetic peptide
KYCGFAQLGELCVLG

SEQ ID NO: 1115 - protein, 16 aa, Artificial Sequence
  Description of Artificial Sequence: Synthetic peptide
KYCGFAQLGELCVLGG

SEQ ID NO: 1116 - protein, 17 aa, Artificial Sequence
  Description of Artificial Sequence: Synthetic peptide
KYCGFAQLGELCVLGGG

SEQ ID NO: 1117 - protein, 16 aa, Artificial Sequence
  Description of Artificial Sequence: Synthetic peptide
GKYCGFAQLGELCVLG

SEQ ID NO: 1118 - protein, 17 aa, Artificial Sequence
  Description of Artificial Sequence: Synthetic peptide
GGKYCGFAQLGELCVLG

SEQ ID NO: 1119 - skipped

SEQ ID NO: 1120 - protein, 14 aa, Artificial Sequence
  Description of Artificial Sequence: Synthetic peptide
YWCWMAQVGELCDL

SEQ ID NO: 1121 - protein, 14 aa, Artificial Sequence
  Description of Artificial Sequence: Synthetic peptide
YHCWMAQVGELCDL

SEQ ID NO: 1122 - protein, 14 aa, Artificial Sequence
  Description of Artificial Sequence: Synthetic peptide
YHCWMGQVGELCDL

SEQ ID NO: 1123 - protein, 14 aa, Artificial Sequence
  Description of Artificial Sequence: Synthetic peptide
YHCWMGQMGELCDL

SEQ ID NO: 1124 - protein, 14 aa, Artificial Sequence
  Description of Artificial Sequence: Synthetic peptide
YHCWMGQMGELCEL

SEQ ID NO: 1125 - protein, 14 aa, Artificial Sequence
  Description of Artificial Sequence: Synthetic peptide
YHCWMGQMGELCEM

SEQ ID NO: 1126-1129 - skipped (4 entries)

SEQ ID NO: 1130 - protein, 20 aa, Artificial Sequence
  Description of Artificial Sequence: Synthetic peptide
YPCWLARVGELCDLDSGDVH

SEQ ID NO: 1131 - protein, 20 aa, Artificial Sequence
  Description of Artificial Sequence: Synthetic peptide
APCWLARVGELCDLDSGDVH

SEQ ID NO: 1132 - protein, 20 aa, Artificial Sequence
  Description of Artificial Sequence: Synthetic peptide
APCALARVGELCDLDSGDVH

SEQ ID NO: 1133 - protein, 20 aa, Artificial Sequence
  Description of Artificial Sequence: Synthetic peptide
APCALAAVGELCDLDSGDVH

SEQ ID NO: 1134 - protein, 20 aa, Artificial Sequence
  Description of Artificial Sequence: Synthetic peptide
APCALAAVGALCDLDSGDVH

SEQ ID NO: 1135 - protein, 20 aa, Artificial Sequence
  Description of Artificial Sequence: Synthetic peptide
APCALAAVGALCDLASGDVH

SEQ ID NO: 1136 - protein, 20 aa, Artificial Sequence
  Description of Artificial Sequence: Synthetic peptide
APCALAAVGALCDLAAGDVH

SEQ ID NO: 1137-9379 - skipped (8243 entries)

SEQ ID NO: 9380 - protein, 20 aa, Artificial Sequence
  Description of Artificial Sequence: Synthetic peptide
  SITE (1)..(20): This sequence may encompass 1-20 residues
GGGGGGGGGGGGGGGGGGGG

SEQ ID NO: 9381 - protein, 40 aa, Artificial Sequence
  Description of Artificial Sequence: Synthetic polypeptide
  SITE (1)..(40): This sequence may encompass 1-20 "Gly Ser" repeating units
GSGSGSGSGSGSGSGSGSGSGSGSGSGSGSGSGSGSGSGS

SEQ ID NO: 9382 - protein, 60 aa, Artificial Sequence
  Description of Artificial Sequence: Synthetic polypeptide
  SITE (1)..(60): This sequence may encompass 1-20 "Gly Gly Ser" repeating units
GGSGGSGGSGGSGGSGGSGGSGGSGGSGGSGGSGGSGGSGGSGGSGGSGGSGGSGGSGGS

SEQ ID NO: 9383 - protein, 80 aa, Artificial Sequence
  Description of Artificial Sequence: Synthetic polypeptide
  SITE (1)..(80): This sequence may encompass 1-20 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 9384 - protein, 100 aa, Artificial Sequence
  Description of Artificial Sequence: Synthetic polypeptide
  SITE (1)..(100): This sequence may encompass 1-20 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 9385 - protein, 10 aa, Artificial Sequence
  Description of Artificial Sequence: Synthetic peptide
  SITE (1)..(10): This sequence may encompass 1-10 residues
GGGGGGGGGG

SEQ ID NO: 9386 - protein, 20 aa, Artificial Sequence
  Description of Artificial Sequence: Synthetic peptide
  SITE (1)..(20): This sequence may encompass 1-10 "Gly Ser" repeating units
GSGSGSGSGSGSGSGSGSGS

SEQ ID NO: 9387 - protein, 30 aa, Artificial Sequence
  Description of Artificial Sequence: Synthetic polypeptide
  SITE (1)..(30): This sequence may encompass 1-10 "Gly Gly Ser" repeating units
GGSGGSGGSGGSGGSGGSGGSGGSGGSGGS

SEQ ID NO: 9388 - protein, 40 aa, Artificial Sequence
  Description of Artificial Sequence: Synthetic polypeptide
  SITE (1)..(40): This sequence may encompass 1-10 "Gly Gly Gly Ser" repeating units
GGGSGGGSGGGSGGGSGGGSGGGSGGGSGGGSGGGSGGGS

SEQ ID NO: 9389 - protein, 50 aa, Artificial Sequence
  Description of Artificial Sequence: Synthetic polypeptide
  SITE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 9390 - protein, 5 aa, Artificial Sequence
  Description of Artificial Sequence: Synthetic peptide
  SITE (1)..(5): This sequence may encompass 1-5 residues
GGGGG

SEQ ID NO: 9391 - protein, 10 aa, Artificial Sequence
  Description of Artificial Sequence: Synthetic peptide
  SITE (1)..(10): This sequence may encompass 1-5 "Gly Ser" repeating units
GSGSGSGSGS

SEQ ID NO: 9392 - protein, 15 aa, Artificial Sequence
  Description of Artificial Sequence: Synthetic peptide
  SITE (1)..(15): This sequence may encompass 1-5 "Gly Gly Ser" repeating units
GGSGGSGGSGGSGGS

SEQ ID NO: 9393 - protein, 20 aa, Artificial Sequence
  Description of Artificial Sequence: Synthetic peptide
  SITE (1)..(20): This sequence may encompass 1-5 "Gly Gly Gly Ser" repeating units
GGGSGGGSGGGSGGGSGGGS

SEQ ID NO: 9394 - protein, 25 aa, Artificial Sequence
  Description of Artificial Sequence: Synthetic peptide
  SITE (1)..(25): This sequence may encompass 1-5 "Gly Gly Gly Gly Ser" repeating units
GGGGSGGGGSGGGGSGGGGSGGGGS

SEQ ID NO: 9395 - protein, 5 aa, Artificial Sequence
  Description of Artificial Sequence: Synthetic peptide
GGGGS

SEQ ID NO: 9396 - protein, 10 aa, Artificial Sequence
  Description of Artificial Sequence: Synthetic peptide
GGGGSGGGGS

SEQ ID NO: 9397 - protein, 15 aa, Artificial Sequence
  Description of Artificial Sequence: Synthetic peptide
GGGGSGGGGSGGGGS

SEQ ID NO: 9398 - protein, 20 aa, Artificial Sequence
  Description of Artificial Sequence: Synthetic peptide
GGGGSGGGGSGGGGSGGGGS

SEQ ID NO: 9399 - protein, 2 aa, Artificial Sequence
  Description of Artificial Sequence: Synthetic peptide
GG

SEQ ID NO: 9400 - protein, 3 aa, Artificial Sequence
  Description of Artificial Sequence: Synthetic peptide
GGG

SEQ ID NO: 9401 - protein, 5 aa, Artificial Sequence
  Description of Artificial Sequence: Synthetic peptide
GGGGG

SEQ ID NO: 9402 - protein, 3 aa, Artificial Sequence
  Description of Artificial Sequence: Synthetic peptide
GGS

SEQ ID NO: 9403 - protein, 4 aa, Artificial Sequence
  Description of Artificial Sequence: Synthetic peptide
GGGS

SEQ ID NO: 9404 - protein, 7 aa, Artificial Sequence
  Description of Artificial Sequence: Synthetic peptide
GGGGSGG

SEQ ID NO: 9405 - protein, 6 aa, Artificial Sequence
  Description of Artificial Sequence: Synthetic peptide
GGSGGS

SEQ ID NO: 9406 - protein, 5 aa, Artificial Sequence
  Description of Artificial Sequence: Synthetic peptide
GGGGG

SEQ ID NO: 9407 - protein, 20 aa, Artificial Sequence
  Description of Artificial Sequence: Synthetic peptide
GSGSGSGSGSGSGSGSGSGS

SEQ ID NO: 9408-9419 - skipped (12 entries)

SEQ ID NO: 9420 - protein, 20 aa, Artificial Sequence
  Description of Artificial Sequence: Synthetic peptide
  SITE (1)..(20): This sequence may encompass 1-20 residues
PPPPPPPPPPPPPPPPPPPP

SEQ ID NO: 9421 - protein, 40 aa, Artificial Sequence
  Description of Artificial Sequence: Synthetic polypeptide
  SITE (1)..(40): This sequence may encompass 1-20 "Pro Ala" repeating units
PAPAPAPAPAPAPAPAPAPAPAPAPAPAPAPAPAPAPAPA

SEQ ID NO: 9422 - protein, 10 aa, Artificial Sequence
  Description of Artificial Sequence: Synthetic peptide
  SITE (1)..(10): This sequence may encompass 1-10 residues
PPPPPPPPPP

SEQ ID NO: 9423 - protein, 20 aa, Artificial Sequence
  Description of Artificial Sequence: Synthetic peptide
  SITE (1)..(20): This sequence may encompass 1-10 "Pro Ala" repeating units
PAPAPAPAPAPAPAPAPAPA

SEQ ID NO: 9424 - protein, 5 aa, Artificial Sequence
  Description of Artificial Sequence: Synthetic peptide
  SITE (1)..(5): This sequence may encompass 1-5 residues
PPPPP

SEQ ID NO: 9425 - protein, 10 aa, Artificial Sequence
  Description of Artificial Sequence: Synthetic peptide
  SITE (1)..(10): This sequence may encompass 1-5 "Pro Ala" repeating units
PAPAPAPAPA

SEQ ID NO: 9426 - protein, 10 aa, Artificial Sequence
  Description of Artificial Sequence: Synthetic peptide
PAPAPAPAPA

SEQ ID NO: 9427 - protein, 14 aa, Artificial Sequence
  Description of Artificial Sequence: Synthetic peptide
PAPAPAPAPAPAPA

SEQ ID NO: 9428 - protein, 20 aa, Artificial Sequence
  Description of Artificial Sequence: Synthetic peptide
PAPAPAPAPAPAPAPAPAPA

SEQ ID NO: 9429 - protein, 20 aa, Artificial Sequence
  Description of Artificial Sequence: Synthetic peptide
  MOD_RES (2)..(2): A, K or E
  MOD_RES (4)..(4): A, K or E
  MOD_RES (6)..(6): A, K or E
  MOD_RES (8)..(8): A, K or E
  MOD_RES (10)..(10): A, K or E
  MOD_RES (12)..(12): A, K or E
  MOD_RES (14)..(14): A, K or E
  MOD_RES (16)..(16): A, K or E
  MOD_RES (18)..(18): A, K or E
  MOD_RES (20)..(20): A, K or E
  SITE (1)..(20): This sequence may encompass 1-10 "Pro Xaa" repeating units; wherein Xaa is Ala, Lys or Glu
PXPXPXPXPXPXPXPXPXPX

What is claimed is:

1. An IL-7Rα ligand, wherein,
   the IL-7Rα ligand binds to the human IL-7Rα subunit with an $IC_{50}$ of less than 100 μM; and
   the IL-7Rα ligand consists of an amino acid sequence selected from any one of SEQ ID NOS: 402, 407, 582, and 655.

2. The IL-7Rα ligand of claim 1, wherein the IL-7Rα ligand consists of the amino acid sequence of SEQ ID NO: 402.

3. The IL-7Rα ligand of claim 1, wherein the IL-7Rα ligand consists of the amino acid sequence of SEQ ID NO: 407.

4. The IL-7Rα ligand of claim 1, wherein the IL-7Rα ligand consists of the amino acid sequence of SEQ ID NO: 582.

5. The IL-7Rα ligand of claim 1, wherein the IL-7Rα ligand consists of the amino acid sequence of SEQ ID NO: 655.

6. A compound comprising at least one IL-7Rα ligand of claim 1.

7. The compound of claim 6, wherein the compound is selected from a peptide, a conjugate, and a fusion protein.

8. A pharmaceutical composition comprising the IL-7Rα ligand of claim 1.

9. A pharmaceutical composition comprising the compound of claim 6.

* * * * *